(12) United States Patent
Feige et al.

(10) Patent No.: US 6,660,843 B1
(45) Date of Patent: Dec. 9, 2003

(54) MODIFIED PEPTIDES AS THERAPEUTIC AGENTS

(75) Inventors: Ulrich Feige, Newbury Park, CA (US); Chuan-Fa Liu, Longmont, CO (US)

(73) Assignee: Amgen Inc., Thousand Oaks, CA (US)

( * ) Notice: Subject to any disclaimer, the term of this patent is extended or adjusted under 35 U.S.C. 154(b) by 0 days.

(21) Appl. No.: 09/428,082

(22) Filed: Oct. 22, 1999

Related U.S. Application Data

(60) Provisional application No. 60/105,371, filed on Oct. 23, 1998.

(51) Int. Cl.⁷ .................................................. C07K 1/00
(52) U.S. Cl. .................. 530/391.7; 530/350; 530/391.1
(58) Field of Search ............................. 530/350, 387.3, 530/391.1, 391.7

(56) References Cited

U.S. PATENT DOCUMENTS

| | | |
|---|---|---|
| 5,098,833 A | 3/1992 | Lasky et al. |
| 5,116,964 A | 5/1992 | Capon et al. |
| 5,216,131 A | 6/1993 | Lasky et al. |
| 5,223,409 A | 6/1993 | Ladner et al. ............ 435/69.7 |
| 5,225,538 A | 7/1993 | Capon et al. |
| 5,336,603 A | 8/1994 | Capon et al. |
| 5,338,665 A | 8/1994 | Schatz et al. .................. 435/6 |
| 5,428,130 A | 6/1995 | Capon et al. |
| 5,432,018 A | 7/1995 | Dower et al. .................... 435/5 |
| 5,455,165 A | 10/1995 | Capon et al. |
| 5,480,981 A | 1/1996 | Goodwin et al. ........... 536/23.5 |
| 5,498,530 A | 3/1996 | Schatz et al. ............. 435/69.1 |
| 5,514,582 A | 5/1996 | Capon et al. |
| 5,565,335 A | 10/1996 | Capon et al. |
| 5,608,035 A | 3/1997 | Yanofsky et al. ........... 530/324 |
| 5,714,147 A | 2/1998 | Capon et al. |
| 5,726,290 A | 3/1998 | Bodary et al. |
| 5,733,731 A | 3/1998 | Schatz et al. .................. 435/6 |
| 5,739,277 A | 4/1998 | Presta et al. ................. 530/326 |
| 5,767,234 A | 6/1998 | Yanofsky et al. ........... 530/327 |
| 5,773,569 A | 6/1998 | Wrighton et al. ........... 530/300 |
| 5,786,331 A | 7/1998 | Barrett et al. .................. 514/15 |
| 5,840,844 A | 11/1998 | Lasky et al. |
| 5,869,451 A | 2/1999 | Dower et al. .................. 514/13 |
| 5,869,452 A | 2/1999 | Ng et al. ....................... 514/14 |
| 5,877,151 A | 3/1999 | Pereira ......................... 514/12 |
| 5,880,096 A | 3/1999 | Barrett et al. ................. 514/15 |
| 5,922,545 A | 7/1999 | Mattheakis et al. ............ 435/6 |
| 5,932,546 A | 8/1999 | Barrett et al. .................. 514/14 |
| 5,985,599 A | 11/1999 | McKenzie et al. |
| 6,117,655 A | 9/2000 | Capon et al. |

FOREIGN PATENT DOCUMENTS

| | | |
|---|---|---|
| EP | 0 526 452 B1 | 2/1993 |
| EP | 714912 | 5/1996 |
| EP | 911393 | 4/1999 |
| EP | 1 029 870 A2 | 8/2000 |
| WO | WO 94/07921 | 4/1994 |
| WO | WO 95/09917 | 4/1995 |
| WO | WO 95/14714 | 6/1995 |
| WO | WO 96/05309 | 2/1996 |
| WO | WO 96/11214 | 4/1996 |
| WO | WO 96/11953 | 4/1996 |
| WO | WO 96/17942 | 6/1996 |
| WO | WO 96/18412 | 6/1996 |
| WO | WO 96/23899 | 8/1996 |
| WO | WO 96/30057 | 10/1996 |
| WO | WO 96/40772 | 12/1996 |
| WO | WO 96/40987 | 12/1996 |
| WO | WO 97/00270 | 1/1997 |
| WO | WO 97/08203 | 3/1997 |
| WO | WO 97/08553 | 3/1997 |
| WO | WO 97/23614 | 7/1997 |
| WO | WO 97/28828 | 8/1997 |
| WO | WO 97/31019 | 8/1997 |
| WO | WO 97/34631 | 9/1997 |
| WO | WO 97/35969 | 10/1997 |
| WO | WO 97/40070 | 10/1997 |
| WO | WO 97/44453 | 11/1997 |
| WO | WO 98/09985 | 3/1998 |
| WO | WO 98/10795 | 3/1998 |
| WO | WO 98/15833 | 4/1998 |
| WO | WO 98/24477 | 6/1998 |
| WO | WO 98/28427 | 7/1998 |
| WO | WO 98/31820 | 7/1998 |
| WO | WO 98/33812 | 8/1998 |
| WO | WO 98/46257 | 10/1998 |
| WO | WO 98/53842 | 12/1998 |
| WO | WO 98/55620 | 12/1998 |
| WO | WO 99/05302 | 2/1999 |
| WO | WO 99/14244 | 3/1999 |
| WO | WO 99/17789 | 4/1999 |
| WO | WO 99/18243 | 4/1999 |
| WO | WO 99/18781 | 4/1999 |
| WO | WO 99/24462 | 5/1999 |
| WO | WO 00/24782 | 5/2000 |

OTHER PUBLICATIONS

Adey et al. (1996), 'Identification of calmodulin–binding peptide consensus sequences from a phage–displayed random peptide library', *Gene* 169:133–134.

(List continued on next page.)

*Primary Examiner*—Sheela Huff
(74) *Attorney, Agent, or Firm*—Timothy J. Gaul; Ron K. Levy; Steven M. Odre

(57) ABSTRACT

The present invention concerns fusion of Fc domains with biologically active peptides and a process for preparing pharmaceutical agents using biologically active peptides. In this invention, pharmacologically active compounds are prepared by a process comprising:

a) selecting at least one peptide that modulates the activity of a protein of interest; and b) preparing a pharmacologic agent comprising an Fc domain covalently linked to at least one amino acid of the selected peptide.

Linkage to the vehicle increases the half-life of the peptide, which otherwise would be quickly degraded in vivo. The preferred vehicle is an Fc domain. The peptide is preferably selected by phage display, *E. coli* display, ribosome display, RNA-peptide screening, or chemical-peptide screening.

10 Claims, 37 Drawing Sheets

OTHER PUBLICATIONS

Adey et al. (1997), 'Isolation of peptides from phage–displayed random peptide libraries that interact with the talin–binding domain of vinculin', *Biochem. J.* 324:523–528.

Ahern et al. (1990), 'Special Report: The Peptide–Oligonucleotide Partnership', *The Scientist 4 (19)*:24–25.

Akeson et al. (1996), 'AF12198, a Novel Low Molecular Weight Antagonist, Selectively Binds the Human Type I Interleukin (IL)–1 Receptor and Blocks in vivo Responses to IL–1', *J. Biol. Chem.* 271:30517–30523.

Ball et al. (1997), 'Cell–cycle arrest and inhibition of Cdk4 activity by small peptides based on the carboxy–terminal domain of $p21^{WAF1}$', *Current Biology* 7;71–80.

Bhatnagar et al. (1996), 'Structure–Activity Relationships of Novel Hematoregulatory Peptides', *J. Med. Chem.* 39:3814–3819.

Böttger et al. (1997), 'Molecular Characterization of the hdm2–p53 Interaction', *J. Mol. Biol.* 269:744–756.

Böttger et al. (1996), 'Identification of novel mdm2 binding peptides by phage display', *Oncogene* 13:2141–2147.

Burstein et al. (1988), 'Thymic Humoral Factor γ2: Purification and Amino Acid Sequence of an Immunoregulatory Peptide from Calf Thymus', *Biochemistry* 27:4066–4071.

Capon et al. (1989), 'Designing CD4 Immunoadhesins for AIDS Therapy', *Nature* 337:525–531.

Chirinos–Rojas et al. (1998), 'A Peptidomimetic Antagonist of TNF–α–Mediated Cytotoxicity Identified from a Phage–Displayed Random Peptide Library', *Journal of Immunology* 161:5621–5626.

Cooper et al. (1987), 'Purification and characterization of a peptide from amyloid–rich pancreases of type 2 diabetic patients', *PNAS* 84:8628–8632.

Cortese et al. (1996), 'Selection of biologically active peptides by phage display of random peptide libraries', *Current Opinion in Biotechnology* 7:616–621.

Couet et al. (1997), 'Identification of Peptide and Protein Ligands for the Caveolin–scaffolding Domain', *The Journal of Biological Chemistry* 272 (10):6525–6533.

Couet et al. (1997), 'Interaction of a Receptor Tyrosine Kinase, EGF–R, with Caveolins', *The Journal of Biological Chemistry* Vol 272 (48):3042–30438.

Cuthbertson et al. (1997), 'Design of Low Molecular Weight Hematoregulatory Agents from the Structure–Activity Relationship of a Dimeric Pentapeptide', *J. Med. Chem* 40:2876–2882.

Cwirla et al. (1997), 'Peptide Agonist of the Thrombopoietin Receptor', *Science* 276:1696–1699.

Dedman et al. (1993), 'Selection of Targeted Biological Modifiers from a Bacteriophage Library of Random Peptides', *The Journal of Biological Chemistry* 268 (31):23025–23030.

Devlin et al. (1990), 'Random Peptide Libraries: A Source of Specific Protein Binding Molecules', *Science* 249:404–406.

Duncan et al. (1988), 'Localization of the binding site for the human high–affinity Fc receptor on IgG', *Nature* 332:563–564.

Dyson et al. (1995), 'Selection of peptide inhibitors of interactions involved in complex protein assemblies: Association of the core and surface antigens of hepatitis B virus', *Proc. Natl. Acad. Sci. USA* 92:2194–2198.

Fahraeus et al. (1996), 'Inhibition of pRb phosphorylation and cell–cycle progression by a 20–residue peptide derived from $P^{16CDKN2}/$INK4A', *Current Biology* 6:84–91.

Fairbrother et al. (1998), 'Novel Peptides Selected to Bind Vascular Endothelial Growth Factor Target the Receptor–B-inding Site', *Biochemistry* 37:17754–17764.

Fisher et al. (1996), 'Treatment of septic shock with the tumor necrosis factor receptor: Fc fusion protein', *N. Eng. J. Med.* 334(26):1697–1702.

Francis, Gillian E. (1992), 'Protein modification and fusion proteins', *Focus on Growth* 3:4–11.

Fukumoto et al. (1998), 'Peptide mimics of the CTLA4–binding domain stimulate T–cell proliferation', *Nature Biotechnology*, 16:267–270.

Gan et al. (1988), 'Echistatin', *JBC* 263:19827–19832.

Ghetie et al. (1997), 'Increasing the serum persistence of an IgG fragment by random mutagenesis', *Nature Biotechnology* 15:637–640.

Gibbs et al. (1994), 'Pharmaceutical Research in Molecular Oncology', *Cell* 79:193–198.

Gibbs et al. (1994), 'Farnesyltransferase Inhibitors: Ras Research Yields a Potential Cancer Therapeutic', *Cell* 77:175–178.

Goodson et al. (1994), 'High–affinity urokinase receptor antagonists identified with bacteriophase peptide display', *Proc. Natl. Acad. Sci. USA* 91:7129–7133.

Harvill et al. (1995), 'An IgG3–IL2 fusion protein activates complement, binds FcγRI, generates LAK activity and shows enhanced binding to the high affinity IL–2R', *Immunotech.* 1:95–105.

Herz et al. (1997), Molecular Approaches to Receptors as Targets for Drug Discovery, *J. of Receptor & Signal Transduction Research* 17(5):671–776.

Hong et al. (1995), 'Protein ligands of the human adenovirus type 2 outer capsid identified by biopanning of a phage–displayed peptide library on separate domains of wild–type and mutant penton capsomers', *The EMBO Journal* 14:4714–4727.

Hughes, David (1998), 'Therapeutic antibodies make a comeback', *Drug Discovery Today* 3(10):439–442.

Inagaki–Ohara et al. (1996), 'Effects of a Nonapeptide Thymic Hormone on Intestinal Intraepithelial Lymphocytes in Mice Following Administration of 5–Fluorouracil[1]', *Cellular Immunology* 17:30–40.

Inglot, Anna D. (1997), 'Classification of Cytokines According to the Receptor Code', *Archivum Immunologies et Therapine Experimentalis* 45:353–357.

Jefferies, D. (1998), 'Selection of Novel Ligands from Phage Display Libraries: An Alternative Approach to Drug and Vaccine Discovery?', *Parasitology Today* 14(5):202–206.

Jefferis et al. (1995), Recognition sites on human IgG for Fcγ receptors: the role of glycosylation, *Immunology Letters* 44:111–117.

Jefferis et al. (1990), 'Molecular Definition of Interaction Sites on Human IgG for Fc Receptors (huFcγ R)', *Molecular Immunology* 27(12):1237–1240.

Jones et al. (1998), 'Stromal Expression of Jagged 1 Promotes Colony Formation by Fetal Hematopoietic Progenitor Cells', *Blood* 92(5):1505–1511.

Junghans, R.P. (1997), Finally! The Brambell Receptor (FcRB), *Immunologic Research* 16(1):29–57.

Kay et al. (1998), 'From peptides to drugs via phage display', *DDT* 3(8): 370–378.

King et al. (1991), 'Modulation of Bone Marrow Stromal Cell Production of Colony Stimulating Activity by the Synthetic Peptide', *Exp. Hematol.* 19:481.

King et al. (1995), 'Hematoregulatory Peptide, SK&F Induced Stromal Cell Production of KC Enhances CFU–GM Growth and Effector Cell Function', *Blood* 86(1):309a.

Kitamura et al. (1993), 'Adrenomedullin: A Novel Hypotensive Peptide Isolated from Human Pheochromocytoma', *BBRC* 192:553–560.

Kluczyk et al. (1997), 'Immunomodulatory Activity of Oligopeptides Related to Interleukin 1 Receptor Antagonist Sequence', *Archivum Immunologiac et Therapiae Experimentals* 45:427–433.

Koivunen et al. (1999), 'Tumor targeting with a selective gelatinase inhibitor', *Nature Biotech.* 17:768–774.

Kreeger, Karen Young (1998), 'Immunological Applications Top List of Peptide–Synthesis Services', *The Scientist* 10(13):19–20.

Laerum et al. (1988), 'The Dimer of Hemoregulatory Peptide (HP5B) Stimulates Mouse and Human Myelopoiesis in vitro', *Exp. Hemat.* 16:274–280.

Linse et al. (1997), 'A Region of Vitamin K–dependent Protein S That Binds to C4b Binding Protein (C4BP) Identified Using Bacteriophage Peptide Display Libraries', *The Journal of Biological Chemistry* 272(23):14658–14665.

Linsley et al. (1991), 'CTLA–4 is a Second Receptor for the B Cell Activation Antigen B7', *J. Exp. Med.* 174:561–569.

Livnah et al. (1996), 'Functional Mimicry of a Protein Hormone by a Peptide Agonist: The EPO Receptor Complex at 2.8 Å', *Science* 273:464–471.

Lowman, H.B. (1997), 'Bacteriophage display and discovery of peptide leads for drug development', *Annu. Rev. Biophys. Biomol. Struct.* 26:401–24.

Martens et al. (1995), 'Peptides which bind to E–selectin and block neutrophil adhesion', *The Journal of Biological Chemistry* 270(36):21129–21136.

McGregor, Duncan (1996), 'Selection of proteins and peptides from libraries displayed on filamentous bacteriophage', *Molecular Biotechnology* 6:155–162.

Moodie et al. (1994), 'The 3Rs of Llife: Ras, Raf and Growth Regulation', *TIG* 10(2):44–48.

Morikis et al. (1998), 'Solution structure of Compstatin, a potent complement inhibitor', *Protein Science* 7:619–627.

Naranda et al. (Jun., 1999), "Activation of erythropoietin receptor in the absence of hormone by a peptide that binds to a domain different from the hormone binding site," *Proc. Natl. Acad. Sci. USA* 96:7569–7574.

Nishi et al. (1996), 'Tight–binding inhibitory sequences against pp60$^{c-src}$ identified using a random 15–amino–acid peptide library', *FEBS* 399:237–240.

Pasquaimi et al. (1996), 'Organ targeting in vivo using phage display peptide libraries', *Nature* 380:364–366.

Paukovits et al. (1984), 'Structural Investigations on a Peptide Regulating Hemopoiesis in vitro and in vivo', *Hoppe–Seylers Z Physiol. Chem* 364:303–311.

Pawson et al. (1993), 'SH2 and SH3 Domains', *Current Biology* 3(7):434–442.

Pierce et al. (1995), 'Identification of cyclized calmodulin antagonists from a phage display random peptide library', *Molecular Diversity* 1:259–265.

Piette et al. (1997), 'Mdm2: keeping p53 under control', *Oncogene* 15:1001–1010.

Powis, Garth (1991), Signalling targets for anticancer drug development, *TiPS* 12:188–194.

Rickles et al. (1994), 'Identification of Src, Fyn, Lyn, PI3K and AbI SH3 domain ligands using phage display libraries', *The EMBO Journal* 13(23):5598–5604.

Rodriguez–Viciana et al. (1994), 'Phosphatidylinositol–3–OH kinase as a direct target of Ras', *Nature* 370:527–532.

Sahu et al. (1996), 'Inhibition of Human Complement by a C3–Binding Peptide Isolated from a Phage–Displayed Random Peptide Library[1]', *The Journal of Immunology* 157:884–891.

Sarmay et al. (1992), 'Mapping and Comparison of the Interaction Sites on the Fc Region of IgG Responsible for Triggering Antibody Dependent Cellular Cytotoxicity (ADCC) Through Different Types of Human Fcγ Receptor', *Molecular Immunology* 29(5):633–639.

Scott et al. (1990), 'Searching for Peptide Ligands with an Epitope Library', *Science* 249:386–390.

Siemion et al. (1991), 'The Evidence on the Possible Interleukin–1α Tuftsin Competition', *Archivum Immunologiae et Therapiae Experimentalis* 39:605–611.

Sparks et al. (1996), 'Distinct ligand preferences of Src homology 3 domains from Src, Yes, Abl, Cortactin, p53bp2, PLCγ, Crk, and Grb2', *Proc. Natl. Acad. Sci. USA* 93:1540–1544.

Sparks et al. (1994), 'Identification and Characterization of Src SH3 Ligands from Phage–displayed Random Peptide Libraries', *The Journal of Biological Chemistry* 269(39):23853–23856.

Stauffer et al. (1997), 'Inhibition of Lyn Function in Mast Cell Activation by SH3 Domain Binding Peptides', *Biochemistry* 36:9388–9394.

Takasaki et al. (1997), 'Structure–based design and characterization of exocyclic peptidomimetics that inhibit TNFα binding to its receptor', *Nature Biotechnology* 15:1266–1270.

Van Zee et al. (1996), 'Protection Against Lethal *Escherichia coli* Bacteremia in Baboons (Papio anubis) by Pretreatment with a 55–kDa TNF Receptor (CD120a)–Ig Fusion Protein, Ro 45–2081', *J. Immunol.* 156:2221–2230.

Wells et al. (1992), 'Rapid evolution of peptide and protein binding properties in vivo', *Current Opinion of Biotechnology* 3:355–362.

Whitty et al. (1996), 'Small molecule cytokine mimetics', *Chemistry & Biology* 6:R107–R118.

Wieczorek et al. (1994), 'The Immunomodulatory Activity of Tetra– and Tripeptides of Tuftsin–Kentsin Group', *Peptides* 15(2):215–221.

Wieczorek et al. (1997), 'A Hexapeptide VTKFYF from C–Terminal Part of Interleukin–1 Receptor Antagonist, an Inhibitor of IL–1—IL–1 Receptor Interaction', *Polish Journal of Pharmacology* 49:107–117.

Wilson et al. (1998), 'Phage display: applications, innovations, and issues in phage and host biology', *Can. J. Microbiol.* 44:313–329.

Wrighton et al. (1997), 'Increased potency of an erythropoietin peptide mimetic through covalent dimerization', *Nature Biotechnology* 15:1261–1265.

Wrighton et al. (1996), 'Small Peptides as Potent Mimetics of the Protein Hormone Erythropoietin', *Science* 273:458–463.

Yanofsky et al. (1996), 'High Affinity type I interleukin 1 receptor antagonists discovered by screening recombinant peptide libraries', *PNAS* 93:7381–7386.

Yoshida et al. (1984), 'The Activity of Synthetic analogs of Serum Thymic Factor (FTS) to Convert Mouse Pre–T Cells into Thy–1 Positive Cells', *Int. J. Immunopharmac.* 6(2):141–146.

Yu et al. (1994), 'Structural Basis for the Binding of Proline–Rich Peptides to SH3 Domains', *Cell* 76:933–945.

Zheng et al. (1995), 'Administration of Noncytolytic IL–10/Fc in Murine Models of Lipopolysaccharide–Induced Septic Shock and Allogeneic Islet Transplantation', *J. Immunol.* 154:5590–5600.

Ishikawa et al (1998), 'GD1α–replica peptides functionally mimic GD1α, an adhesion molecule of metastatic tumor cells, and suppress the tumor metastasis', *FEBS* 441:20–24.

Kraft et al. (1999), 'Definition of an Unexpected Ligand Recognition Motif for αvβ6 Integrin', *Journal of Biological Chemistry* 274(4):1979–1985.

Maurer et al. (1997), 'Autodisplay: One–Component System for Efficient Surface Display and Release of Soluble Recombinant Proteins from *Escherichia coli*', *ournal of Bacteriology* 179(3):794–80.

Brocks et al. (1997), "A TNF receptor antagonistic scFv, which is not secreted in mammalian cells, is expressed as a soluble mono– and bivalent scFv derivative in insect cells," *Immunotechnology* 3(3):173–184.

Johnson et al. (1998), "Identification of a 13 amino acid peptide mimetic of erythropoietin and description of amino acids critical for the mimetic activity of EMP1," *Biochemistry* 37(11):3699–3710.

Loetscher et al. (1993), "Efficacy of a chimeric TNFR–IgG fusion protein to inhibit TNF activity in animal models of septic shock," *Elsevier Science Publishers* pp. 455–462.

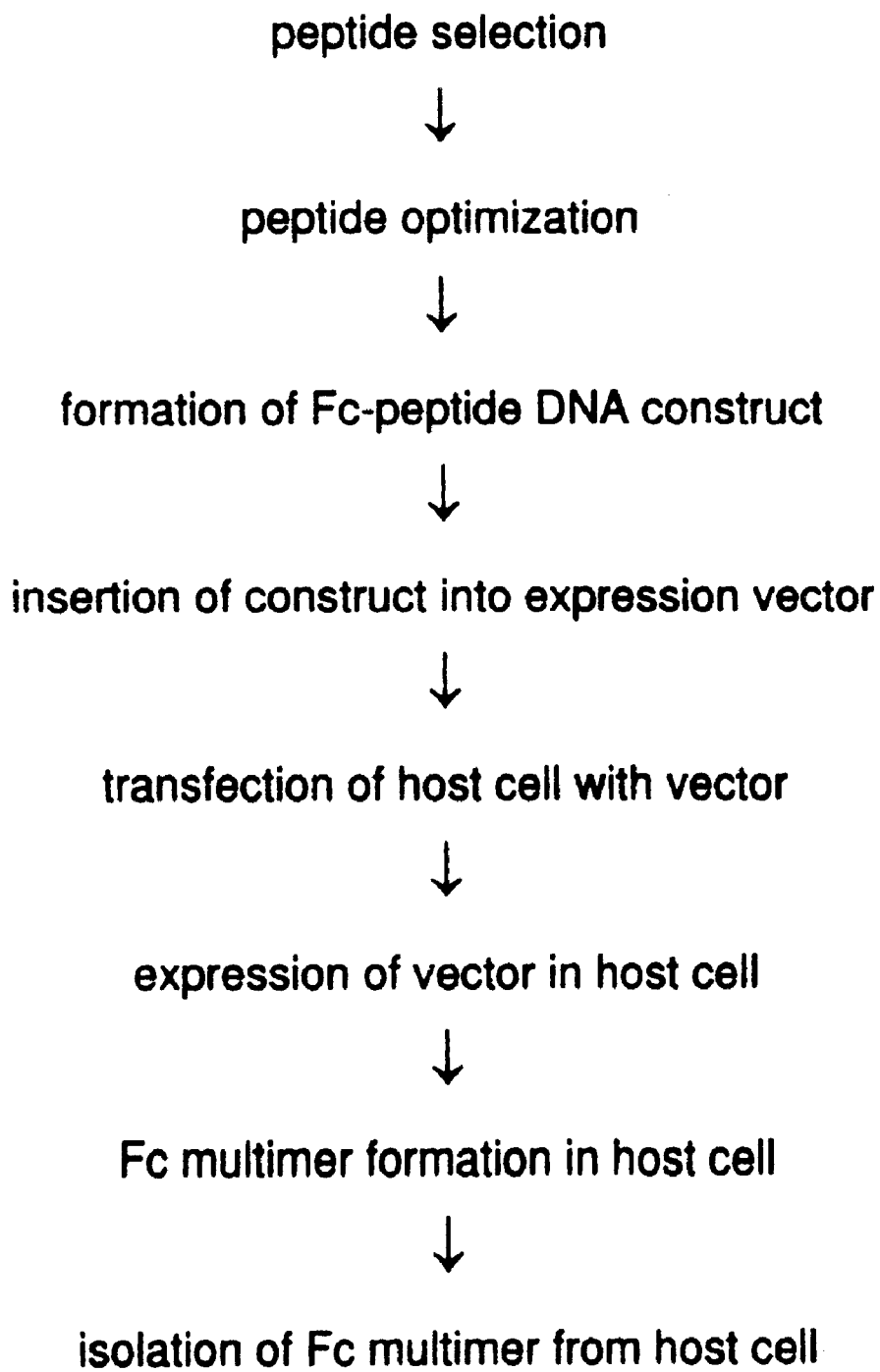

FIG. 4

```
      ATGGACAAAACTCACACATGTCCACCTTGTCCAGCTCCGGAACTCCTGGGGGGACCGTCA
    1 ---------+---------+---------+---------+---------+---------+ 60
      TACCTGTTTTGAGTGTGTACAGGTGGAACAGGTCGAGGCCTTGAGGACCCCCCTGGCAGT a     M  D  K  T  H  T  C  P  P  C  P  A  P  E  L  L  G  G  P  S   -

GTCTTCCTCTTCCCCCCAAAACCCAAGGACACCCTCATGATCTCCCGGACCCCTGAGGTC
   61 ---------+---------+---------+---------+---------+---------+ 120
      CAGAAGGAGAAGGGGGGTTTTGGGTTCCTGTGGGAGTACTAGAGGGCCTGGGGACTCCAG a     V  F  L  F  P  P  K  P  K  D  T  L  M  I  S  R  T  P  E  V   -

ACATGCGTGGTGGTGGACGTGAGCCACGAAGACCCTGAGGTCAAGTTCAACTGGTACGTG
  121 ---------+---------+---------+---------+---------+---------+ 180
      TGTACGCACCACCACCTGCACTCGGTGCTTCTGGGACTCCAGTTCAAGTTGACCATGCAC a     T  C  V  V  V  D  V  S  H  E  D  P  E  V  K  F  N  W  Y  V   -

GACGGCGTGGAGGTGCATAATGCCAAGACAAAGCCGCGGGAGGAGCAGTACAACAGCACG
  181 ---------+---------+---------+---------+---------+---------+ 240
      CTGCCGCACCTCCACGTATTACGGTTCTGTTTCGGCGCCCTCCTCGTCATGTTGTCGTGC a     D  G  V  E  V  H  N  A  K  T  K  P  R  E  E  Q  Y  N  S  T   -

TACCGTGTGGTCAGCGTCCTCACCGTCCTGCACCAGGACTGGCTGAATGGCAAGGAGTAC
  241 ---------+---------+---------+---------+---------+---------+ 300
      ATGGCACACCAGTCGCAGGAGTGGCAGGACGTGGTCCTGACCGACTTACCGTTCCTCATG a     Y  R  V  V  S  V  L  T  V  L  H  Q  D  W  L  N  G  K  E  Y   -

AAGTGCAAGGTCTCCAACAAAGCCCTCCCAGCCCCCATCGAGAAAACCATCTCCAAAGCC
  301 ---------+---------+---------+---------+---------+---------+ 360
      TTCACGTTCCAGAGGTTGTTTCGGGAGGGTCGGGGGTAGCTCTTTTGGTAGAGGTTTCGG a     K  C  K  V  S  N  K  A  L  P  A  P  I  E  K  T  I  S  K  A   -

AAAGGGCAGCCCCGAGAACCACAGGTGTACACCCTGCCCCCATCCCGGGATGAGCTGACC
  361 ---------+---------+---------+---------+---------+---------+ 420
      TTTCCCGTCGGGGCTCTTGGTGTCCACATGTGGGACGGGGGTAGGGCCCTACTCGACTGG a     K  G  Q  P  R  E  P  Q  V  Y  T  L  P  P  S  R  D  E  L  T   -

AAGAACCAGGTCAGCCTGACCTGCCTGGTCAAAGGCTTCTATCCCAGCGACATCGCCGTG
  421 ---------+---------+---------+---------+---------+---------+ 480
      TTCTTGGTCCAGTCGGACTGGACGGACCAGTTTCCGAAGATAGGGTCGCTGTAGCGGCAC a     K  N  Q  V  S  L  T  C  L  V  K  G  F  Y  P  S  D  I  A  V   -

GAGTGGGAGAGCAATGGGCAGCCGGAGAACAACTACAAGACCACGCCTCCCGTGCTGGAC
  481 ---------+---------+---------+---------+---------+---------+ 540
      CTCACCCTCTCGTTACCCGTCGGCCTCTTGTTGATGTTCTGGTGCGGAGGGCACGACCTG a     E  W  E  S  N  G  Q  P  E  N  N  Y  K  T  T  P  P  V  L  D   -

TCCGACGGCTCCTTCTTCCTCTACAGCAAGCTCACCGTGGACAAGAGCAGGTGGCAGCAG
  541 ---------+---------+---------+---------+---------+---------+ 600
      AGGCTGCCGAGGAAGAAGGAGATGTCGTTCGAGTGGCACCTGTTCTCGTCCACCGTCGTC a     S  D  G  S  F  F  L  Y  S  K  L  T  V  D  K  S  R  W  Q  Q   -

GGGAACGTCTTCTCATGCTCCGTGATGCATGAGGCTCTGCACAACCACTACACGCAGAAG
  601 ---------+---------+---------+---------+---------+---------+ 660
      CCCTTGCAGAAGAGTACGAGGCACTACGTACTCCGAGACGTGTTGGTGATGTGCGTCTTC a     G  N  V  F  S  C  S  V  M  H  E  A  L  H  N  H  Y  T  Q  K   -

AGCCTCTCCCTGTCTCCGGGTAAA
  661 ---------+---------+----  684
      TCGGAGAGGGACAGAGGCCCATTT
```

FIG. 7

```
     XbaI
     |
     TCTAGATTTGTTTTAACTAATTAAAGGAGGAATAACATATGGACAAAACTCACACATGTC
  1  ----------+----------+----------+----------+----------+----------+ 60
     AGATCTAAACAAAATTGATTAATTTCCTCCTTATTGTATACCTGTTTTGAGTGTGTACAG
c                                         M  D  K  T  H  T  C  P -

CACCTTGTCCAGCTCCGGAACTCCTGGGGGACCGTCAGTCTTCCTCTTCCCCCCAAAAC
 61  ----------+----------+----------+----------+----------+----------+ 120
     GTGGAACAGGTCGAGGCCTTGAGGACCCCCTGGCAGTCAGAAGGAGAAGGGGGGTTTTG
c     P  C  P  A  P  E  L  L  G  G  P  S  V  F  L  F  P  P  K  P -

CCAAGGACACCCTCATGATCTCCCGGACCCCTGAGGTCACATGCGTGGTGGTGGACGTGA
121  ----------+----------+----------+----------+----------+----------+ 180
     GGTTCCTGTGGGAGTACTAGAGGGCCTGGGGACTCCAGTGTACGCACCACCACCTGCACT
c     K  D  T  L  M  I  S  R  T  P  E  V  T  C  V  V  V  D  V  S -

GCCACGAAGACCCTGAGGTCAAGTTCAACTGGTACGTGGACGGCGTGGAGGTGCATAATG
181  ----------+----------+----------+----------+----------+----------+ 240
     CGGTGCTTCTGGGACTCCAGTTCAAGTTGACCATGCACCTGCCGCACCTCCACGTATTAC
c     H  E  D  P  E  V  K  F  N  W  Y  V  D  G  V  E  V  H  N  A -

CCAAGACAAAGCCGCGGGAGGAGCAGTACAACAGCACGTACCGTGTGGTCAGCGTCCTCA
241  ----------+----------+----------+----------+----------+----------+ 300
     GGTTCTGTTTCGGCGCCCTCCTCGTCATGTTGTCGTGCATGGCACACCAGTCGCAGGAGT
c     K  T  K  P  R  E  E  Q  Y  N  S  T  Y  R  V  V  S  V  L  T -

CCGTCCTGCACCAGGACTGGCTGAATGGCAAGGAGTACAAGTGCAAGGTCTCCAACAAAG
301  ----------+----------+----------+----------+----------+----------+ 360
     GGCAGGACGTGGTCCTGACCGACTTACCGTTCCTCATGTTCACGTTCCAGAGGTTGTTTC
c     V  L  H  Q  D  W  L  N  G  K  E  Y  K  C  K  V  S  N  K  A -

CCCTCCCAGCCCCCATCGAGAAAACCATCTCCAAAGCCAAAGGGCAGCCCCGAGAACCAC
361  ----------+----------+----------+----------+----------+----------+ 420
     GGGAGGGTCGGGGGTAGCTCTTTTGGTAGAGGTTTCGGTTTCCCGTCGGGGCTCTTGGTG
c     L  P  A  P  I  E  K  T  I  S  K  A  K  G  Q  P  R  E  P  Q -

AGGTGTACACCCTGCCCCCATCCCGGGATGAGCTGACCAAGAACCAGGTCAGCCTGACCT
421  ----------+----------+----------+----------+----------+----------+ 480
     TCCACATGTGGGACGGGGGTAGGGCCCTACTCGACTGGTTCTTGGTCCAGTCGGACTGGA
c     V  Y  T  L  P  P  S  R  D  E  L  T  K  N  Q  V  S  L  T  C -

GCCTGGTCAAAGGCTTCTATCCCAGCGACATCGCCGTGGAGTGGGAGAGCAATGGGCAGC
481  ----------+----------+----------+----------+----------+----------+ 540
     CGGACCAGTTTCCGAAGATAGGGTCGCTGTAGCGGCACCTCACCCTCTCGTTACCCGTCG
c     L  V  K  G  F  Y  P  S  D  I  A  V  E  W  E  S  N  G  Q  P -

CGGAGAACAACTACAAGACCACGCCTCCCGTGCTGGACTCCGACGGCTCCTTCTTCCTCT
541  ----------+----------+----------+----------+----------+----------+ 600
     GCCTCTTGTTGATGTTCTGGTGCGGAGGGCACGACCTGAGGCTGCCGAGGAAGAAGGAGA
c     E  N  N  Y  K  T  T  P  P  V  L  D  S  D  G  S  F  F  L  Y -

ACAGCAAGCTCACCGTGGACAAGAGCAGGTGGCAGCAGGGGAACGTCTTCTCATGCTCCG
601  ----------+----------+----------+----------+----------+----------+ 660
     TGTCGTTCGAGTGGCACCTGTTCTCGTCCACCGTCGTCCCCTTGCAGAAGAGTACGAGGC
c     S  K  L  T  V  D  K  S  R  W  Q  Q  G  N  V  F  S  C  S  V -

TGATGCATGAGGCTCTGCACAACCACTACACGCAGAAGAGCCTCTCCCTGTCTCCGGGTA
661  ----------+----------+----------+----------+----------+----------+ 720
     ACTACGTACTCCGAGACGTGTTGGTGATGTGCGTCTTCTCGGAGAGGGACAGAGGCCCAT
c     M  H  E  A  L  H  N  H  Y  T  Q  K  S  L  S  L  S  P  G  K -

AAGGTGGAGGTGGTGGTATCGAAGGTCCGACTCTGCGTCAGTGGCTGGCTGCTCGTGCTT
721  ----------+----------+----------+----------+----------+----------+ 780
     TTCCACCTCCACCACCATAGCTTCCAGGCTGAGACGCAGTCACCGACCGACGAGCACGAA
c     G  G  G  G  I  E  G  P  T  L  R  Q  W  L  A  A  R  A  *  -

BamHI
     |
     AATCTCGAGGATCC
781  ----------+---- 794
     TTAGAGCTCCTAGG
```

```
     XbaI
      |
     TCTAGATTTGTTTTAACTAATTAAAGGAGGAATAACATATGATCGAAGGTCCGACTCTGC
   1 ------------+---------+---------+---------+---------+---------+ 60
     AGATCTAAACAAAATTGATTAATTTCCTCCTTATTGTATACTAGCTTCCAGGCTGAGACG
c                                          M  I  E  G  P  T  L  R -

GTCAGTGGCTGGCTGCTCGTGCTGGCGGTGGTGGCGGAGGGGGTGGCATTGAGGGCCCAA
  61 ------------+---------+---------+---------+---------+---------+ 120
     CAGTCACCGACCGACGAGCACGACCGCCACCACCGCCTCCCCCACCGTAACTCCCGGGTT
c     Q  W  L  A  A  R  A  G  G  G  G  G  G  I  E  G  P  T -

CCCTTCGCCAATGGCTTGCAGCACGCGCAGGGGGAGGCGGTGGGGACAAAACTCACACAT
 121 ------------+---------+---------+---------+---------+---------+ 180
     GGGAAGCGGTTACCGAACGTCGTGCGCGTCCCCCTCCGCCACCCCTGTTTTGAGTGTGTA
c     L  R  Q  W  L  A  A  R  A  G  G  G  G  D  K  T  H  T  C -

GTCCACCTTGCCCAGCACCTGAACTCCTGGGGGGACCGTCAGTTTTCCTCTTCCCCCCAA
 181 ------------+---------+---------+---------+---------+---------+ 240
     CAGGTGGAACGGGTCGTGGACTTGAGGACCCCCCTGGCAGTCAAAAGGAGAAGGGGGGTT
c     P  P  C  P  A  P  E  L  L  G  G  P  S  V  F  L  F  P  P  K -

AACCCAAGGACACCCTCATGATCTCCCGGACCCCTGAGGTCACATGCGTGGTGGTGGACG
 241 ------------+---------+---------+---------+---------+---------+ 300
     TTGGGTTCCTGTGGGAGTACTAGAGGGCCTGGGGACTCCAGTGTACGCACCACCACCTGC
c     P  K  D  T  L  M  I  S  R  T  P  E  V  T  C  V  V  V  D  V -

TGAGCCACGAAGACCCTGAGGTCAAGTTCAACTGGTACGTGGACGGCGTGGAGGTGCATA
 301 ------------+---------+---------+---------+---------+---------+ 360
     ACTCGGTGCTTCTGGGACTCCAGTTCAAGTTGACCATGCACCTGCCGCACCTCCACGTAT
c      S  H  E  D  P  E  V  K  F  N  W  Y  V  D  G  V  E  V  H  N -

ATGCCAAGACAAAGCCGCGGGAGGAGCAGTACAACAGCACGTACCGTGTGGTCAGCGTCC
 361 ------------+---------+---------+---------+---------+---------+ 420
     TACGGTTCTGTTTCGGCGCCCTCCTCGTCATGTTGTCGTGCATGGCACACCAGTCGCAGG
c      A  K  T  K  P  R  E  E  Q  Y  N  S  T  Y  R  V  V  S  V  L -

TCACCGTCCTGCACCAGGACTGGCTGAATGGCAAGGAGTACAAGTGCAAGGTCTCCAACA
 421 ------------+---------+---------+---------+---------+---------+ 480
     AGTGGCAGGACGTGGTCCTGACCGACTTACCGTTCCTCATGTTCACGTTCCAGAGGTTGT
c      T  V  L  H  Q  D  W  L  N  G  K  E  Y  K  C  K  V  S  N  K -

AAGCCCTCCCAGCCCCCATCGAGAAAACCATCTCCAAAGCCAAAGGGCAGCCCCGAGAAC
 481 ------------+---------+---------+---------+---------+---------+ 540
     TTCGGGAGGGTCGGGGGTAGCTCTTTTGGTAGAGGTTTCGGTTTCCCGTCGGGGCTCTTG
c      A  L  P  A  P  I  E  K  T  I  S  K  A  K  G  Q  P  R  E  P -

CACAGGTGTACACCCTGCCGCCATCCCGGGATGAGCTGACCAAGAACCAGGTCAGCCTGA
 541 ------------+---------+---------+---------+---------+---------+ 600
     GTGTCCACATGTGGGACGGCGGTAGGGCCCTACTCGACTGGTTCTTGGTCCAGTCGGACT
c      Q  V  Y  T  L  P  P  S  R  D  E  L  T  K  N  Q  V  S  L  T -

CCTGCCTGGTCAAAGGCTTCTATCCCAGCGACATCGCCGTGGAGTGGGAGAGCAATGGGC
 601 ------------+---------+---------+---------+---------+---------+ 660
     GGACGGACCAGTTTCCGAAGATAGGGTCGCTGTAGCGGCACCTCACCCTCTCGTTACCCG
c      C  L  V  K  G  F  Y  P  S  D  I  A  V  E  W  E  S  N  G  Q -

AGCCGGAGAACAACTACAAGACCACGCCTCCCGTGCTGGACTCCGACGGCTCCTTCTTCC
 661 ------------+---------+---------+---------+---------+---------+ 720
     TCGGCCTCTTGTTGATGTTCTGGTGCGGAGGGCACGACCTGAGGCTGCCGAGGAAGAAGG
c      P  E  N  N  Y  K  T  T  P  P  V  L  D  S  D  G  S  F  F  L -

TCTACAGCAAGCTCACCGTGGACAAGAGCAGGTGGCAGCAGGGGAACGTCTTCTCATGCT
 721 ------------+---------+---------+---------+---------+---------+ 780
     AGATGTCGTTCGAGTGGCACCTGTTCTCGTCCACCGTCGTCCCCTTGCAGAAGAGTACGA
c      Y  S  K  L  T  V  D  K  S  R  W  Q  Q  G  N  V  F  S  C  S -

CCGTGATGCATGAGGCTCTGCACAACCACTACACGCAGAAGAGCCTCTCCCTGTCTCCGG
 781 ------------+---------+---------+---------+---------+---------+ 840
     GGCACTACGTACTCCGAGACGTGTTGGTGATGTGCGTCTTCTCGGAGAGGGACAGAGGCC
c      V  M  H  E  A  L  H  N  H  Y  T  Q  K  S  L  S  L  S  P  G -

BamHI
      |
     GTAAATAATGGATCC
 841 ------+------ 855
     CATTTATTACCTAGG
c     K  *
```

FIG. 10

```
      XbaI
      |
      TCTAGATTTGTTTTAACTAATTAAAGGAGGAATAACATATGATCGAAGGTCCGACTCTGC
    1 ----------+---------+---------+---------+---------+---------+ 60
      AGATCTAAACAAAATTGATTAATTTCCTCCTTATTGTATACTAGCTTCCAGGCTGAGACG
c                                        M  I  E  G  P  T  L  R  -

GTCAGTGGCTGGCTGCTCGTGCTGGTGGAGGCGGTGGGGACAAAACTCACACATGTCCAC
   61 ----------+---------+---------+---------+---------+---------+ 120
      CAGTCACCGACCGACGAGCACGACCACCTCCGCCACCCCTGTTTTGAGTGTGTACAGGTG
c      Q  W  L  A  A  R  A  G  G  G  G  G  D  K  T  H  T  C  P  P  -

CTTGCCCAGCACCTGAACTCCTGGGGGGACCGTCAGTTTTCCTCTTCCCCCCAAAACCCA
  121 ----------+---------+---------+---------+---------+---------+ 180
      GAACGGGTCGTGGACTTGAGGACCCCCCTGGCAGTCAAAAGGAGAAGGGGGGTTTTGGGT
c      C  P  A  P  E  L  L  G  G  P  S  V  F  L  F  P  P  K  P  K  -

AGGACACCCTCATGATCTCCCGGACCCCTGAGGTCACATGCGTGGTGGTGGACGTGAGCC
  181 ----------+---------+---------+---------+---------+---------+ 240
      TCCTGTGGGAGTACTAGAGGGCCTGGGGACTCCAGTGTACGCACCACCACCTGCACTCGG
c      D  T  L  M  I  S  R  T  P  E  V  T  C  V  V  V  D  V  S  H  -

ACGAAGACCCTGAGGTCAAGTTCAACTGGTACGTGGACGGCGTGGAGGTGCATAATGCCA
  241 ----------+---------+---------+---------+---------+---------+ 300
      TGCTTCTGGGACTCCAGTTCAAGTTGACCATGCACCTGCCGCACCTCCACGTATTACGGT
c      E  D  P  E  V  K  F  N  W  Y  V  D  G  V  E  V  H  N  A  K  -

AGACAAAGCCGCGGGAGGAGCAGTACAACAGCACGTACCGTGTGGTCAGCGTCCTCACCG
  301 ----------+---------+---------+---------+---------+---------+ 360
      TCTGTTTCGGCGCCCTCCTCGTCATGTTGTCGTGCATGGCACACCAGTCGCAGGAGTGGC
c      T  K  P  R  E  E  Q  Y  N  S  T  Y  R  V  V  S  V  L  T  V  -

TCCTGCACCAGGACTGGCTGAATGGCAAGGAGTACAAGTGCAAGGTCTCCAACAAAGCCC
  361 ----------+---------+---------+---------+---------+---------+ 420
      AGGACGTGGTCCTGACCGACTTACCGTTCCTCATGTTCACGTTCCAGAGGTTGTTTCGGG
c      L  H  Q  D  W  L  N  G  K  E  Y  K  C  K  V  S  N  K  A  L  -

TCCCAGCCCCCATCGAGAAAACCATCTCCAAAGCCAAAGGGCAGCCCCGAGAACCACAGG
  421 ----------+---------+---------+---------+---------+---------+ 480
      AGGGTCGGGGGTAGCTCTTTTGGTAGAGGTTTCGGTTTCCCGTCGGGGCTCTTGGTGTCC
c      P  A  P  I  E  K  T  I  S  K  A  K  G  Q  P  R  E  P  Q  V  -

TGTACACCCTGCCCCCATCCCGGGATGAGCTGACCAAGAACCAGGTCAGCCTGACCTGCC
  481 ----------+---------+---------+---------+---------+---------+ 540
      ACATGTGGGACGGGGGTAGGGCCCTACTCGACTGGTTCTTGGTCCAGTCGGACTGGACGG
c      Y  T  L  P  P  S  R  D  E  L  T  K  N  Q  V  S  L  T  C  L  -

TGGTCAAAGGCTTCTATCCCAGCGACATCGCCGTGGAGTGGGAGAGCAATGGGCAGCCGG
  541 ----------+---------+---------+---------+---------+---------+ 600
      ACCAGTTTCCGAAGATAGGGTCGCTGTAGCGGCACCTCACCCTCTCGTTACCCGTCGGCC
c      V  K  G  F  Y  P  S  D  I  A  V  E  W  E  S  N  G  Q  P  E  -

AGAACAACTACAAGACCACGCCTCCCGTGCTGGACTCCGACGGCTCCTTCTTCCTCTACA
  601 ----------+---------+---------+---------+---------+---------+ 660
      TCTTGTTGATGTTCTGGTGCGGAGGGCACGACCTGAGGCTGCCGAGGAAGAAGGAGATGT
c      N  N  Y  K  T  T  P  P  V  L  D  S  D  G  S  F  F  L  Y  S  -

GCAAGCTCACCGTGGACAAGAGCAGGTGGCAGCAGGGGAACGTCTTCTCATGCTCCGTGA
  661 ----------+---------+---------+---------+---------+---------+ 720
      CGTTCGAGTGGCACCTGTTCTCGTCCACCGTCGTCCCCTTGCAGAAGAGTACGAGGCACT
c      K  L  T  V  D  K  S  R  W  Q  Q  G  N  V  F  S  C  S  V  M  -

TGCATGAGGCTCTGCACAACCACTACACGCAGAAGAGCCTCTCCCTGTCTCCGGGTAAAT
  721 ----------+---------+---------+---------+---------+---------+ 780
      ACGTACTCCGAGACGTGTTGGTGATGTGCGTCTTCTCGGAGAGGGACAGAGGCCCATTTA
c      H  E  A  L  H  N  H  Y  T  Q  K  S  L  S  L  S  P  G  K  *  -

BamHI
      |
      AATGGATCC
  781 --------- 789
      TTACCTAGG
```

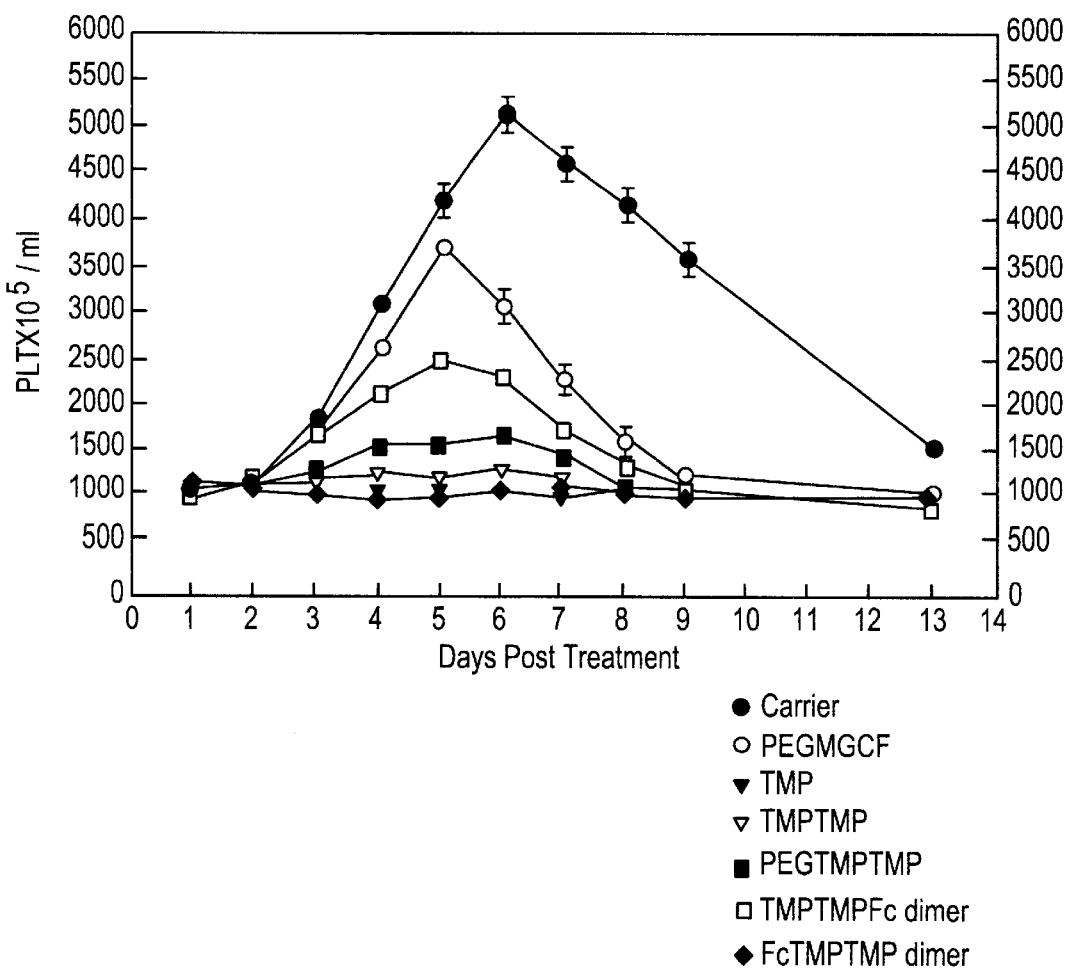

FIG. 13

```
    XbaI
     |
     TCTAGATTTGTTTTAACTAATTAAAGGAGGAATAACATATGGACAAAACTCACACATGTC
 1   ............+............+............+............+............+............+  60
     AGATCTAAACAAAATTGATTAATTTCCTCCTTATTGTATACCTGTTTTGAGTGTGTACAG
c                                             M  D  K  T  H  T  C  P -

CACCTTGTCCAGCTCCGGAACTCCTGGGGGACCGTCAGTCTTCCTCTTCCCCCCAAAAC
 61  ............+............+............+............+............+............+ 120
     GTGGAACAGGTCGAGGCCTTGAGGACCCCCTGGCAGTCAGAAGGAGAAGGGGGGTTTTG
c     P  C  P  A  P  E  L  L  G  G  P  S  V  F  L  F  P  P  K  P -

CCAAGGACACCCTCATGATCTCCCGGACCCCTGAGGTCACATGCGTGGTGGTGGACGTGA
121  ............+............+............+............+............+............+ 180
     GGTTCCTGTGGGAGTACTAGAGGGCCTGGGGACTCCAGTGTACGCACCACCACCTGCACT
c     K  D  T  L  M  I  S  R  T  P  E  V  T  C  V  V  V  D  V  S -

GCCACGAAGACCCTGAGGTCAAGTTCAACTGGTACGTGGACGGCGTGGAGGTGCATAATG
181  ............+............+............+............+............+............+ 240
     CGGTGCTTCTGGGACTCCAGTTCAAGTTGACCATGCACCTGCCGCACCTCCACGTATTAC
c     H  E  D  P  E  V  K  F  N  W  Y  V  D  G  V  E  V  H  N  A -

CCAAGACAAAGCCGCGGGAGGAGCAGTACAACAGCACGTACCGTGTGGTCAGCGTCCTCA
241  ............+............+............+............+............+............+ 300
     GGTTCTGTTTCGGCGCCCTCCTCGTCATGTTGTCGTGCATGGCACACCAGTCGCAGGAGT
c     K  T  K  P  R  E  E  Q  Y  N  S  T  Y  R  V  V  S  V  L  T -

CCGTCCTGCACCAGGACTGGCTGAATGGCAAGGAGTACAAGTGCAAGGTCTCCAACAAAG
301  ............+............+............+............+............+............+ 360
     GGCAGGACGTGGTCCTGACCGACTTACCGTTCCTCATGTTCACGTTCCAGAGGTTGTTTC
c     V  L  H  Q  D  W  L  N  G  K  E  Y  K  C  K  V  S  N  K  A -

CCCTCCCAGCCCCCATCGAGAAAACCATCTCCAAAGCCAAAGGGCAGCCCCGAGAACCAC
361  ............+............+............+............+............+............+ 420
     GGGAGGGTCGGGGGTAGCTCTTTTGGTAGAGGTTTCGGTTTCCCGTCGGGGCTCTTGGTG
c     L  P  A  P  I  E  K  T  I  S  K  A  K  G  Q  P  R  E  P  Q -

AGGTGTACACCCTGCCCCCATCCCGGGATGAGCTGACCAAGAACCAGGTCAGCCTGACCT
421  ............+............+............+............+............+............+ 480
     TCCACATGTGGGACGGGGGTAGGGCCCTACTCGACTGGTTCTTGGTCCAGTCGGACTGGA
c     V  Y  T  L  P  P  S  R  D  E  L  T  K  N  Q  V  S  L  T  C -

GCCTGGTCAAAGGCTTCTATCCCAGCGACATCGCCGTGGAGTGGGAGAGCAATGGGCAGC
481  ............+............+............+............+............+............+ 540
     CGGACCAGTTTCCGAAGATAGGGTCGCTGTAGCGGCACCTCACCCTCTCGTTACCCGTCG
c     L  V  K  G  F  Y  P  S  D  I  A  V  E  W  E  S  N  G  Q  P -

CGGAGAACAACTACAAGACCACGCCTCCCGTGCTGGACTCCGACGGCTCCTTCTTCCTCT
541  ............+............+............+............+............+............+ 600
     GCCTCTTGTTGATGTTCTGGTGCGGAGGGCACGACCTGAGGCTGCCGAGGAAGAAGGAGA
c     E  N  N  Y  K  T  T  P  P  V  L  D  S  D  G  S  F  F  L  Y -

ACAGCAAGCTCACCGTGGACAAGAGCAGGTGGCAGCAGGGGAACGTCTTCTCATGCTCCG
601  ............+............+............+............+............+............+ 660
     TGTCGTTCGAGTGGCACCTGTTCTCGTCCACCGTCGTCCCCTTGCAGAAGAGTACGAGGC
c     S  K  L  T  V  D  K  S  R  W  Q  Q  G  N  V  F  S  C  S  V -

TGATGCATGAGGCTCTGCACAACCACTACACGCAGAAGAGCCTCTCCCTGTCTCCGGGTA
661  ............+............+............+............+............+............+ 720
     ACTACGTACTCCGAGACGTGTTGGTGATGTGCGTCTTCTCGGAGAGGGACAGAGGCCCAT
c     M  H  E  A  L  H  N  H  Y  T  Q  K  S  L  S  L  S  P  G  K -

AAGGTGGAGGTGGTGGTGGAGGTACTTACTCTTGCCACTTCGGCCCGCTGACTTGGGTTT
721  ............+............+............+............+............+............+ 780
     TTCCACCTCCACCACCACCTCCATGAATGAGAACGGTGAAGCCGGGCGACTGAACCCAAA
c     G  G  G  G  G  G  T  Y  S  C  H  F  G  P  L  T  W  V  C -

BamHI
              |
     GCAAACCGCAGGGTGGTTAATCTCGTGGATCC
781  ............+............+............+--- 812
     CGTTTGGCGTCCCACCAATTAGAGCACCTAGG
c     K  P  Q  G  G  *
```

FIG. 14

```
     XbaI
      |
     TCTAGATTTGTTTTAACTAATTAAAGGAGGAATAACATATGGGAGGTACTTACTCTTGCC
  1  ------------+---------+---------+---------+---------+---------+  60
     AGATCTAAACAAAATTGATTAATTTCCTCCTTATTGTATACCCTCCATGAATGAGAACGG
c                                        M  G  G  T  Y  S  C  H -

ACTTCGGCCCGCTGACTTGGGTATGTAAGCCACAAGGGGGTGGGGGAGGCGGGGGGGACA
 61  ------------+---------+---------+---------+---------+---------+ 120
     TGAAGCCGGGCGACTGAACCCATACATTCGGTGTTCCCCCACCCCCTCCGCCCCCCCTGT
c     F  G  P  L  T  W  V  C  K  P  Q  G  G  G  G  G  G  G  D  K -

AAACTCACACATGTCCACCTTGCCCAGCACCTGAACTCCTGGGGGGACCGTCAGTTTTCC
121  ------------+---------+---------+---------+---------+---------+ 180
     TTTGAGTGTGTACAGGTGGAACGGGTCGTGGACTTGAGGACCCCCTGGCAGTCAAAAGG
c     T  H  T  C  P  P  C  P  A  P  E  L  L  G  G  P  S  V  F  L -

TCTTCCCCCCAAAACCCAAGGACACCCTCATGATCTCCCGGACCCCTGAGGTCACATGCG
181  ------------+---------+---------+---------+---------+---------+ 240
     AGAAGGGGGGTTTTGGGTTCCTGTGGGAGTACTAGAGGGCCTGGGGACTCCAGTGTACGC
c     F  P  P  K  P  K  D  T  L  M  I  S  R  T  P  E  V  T  C  V -

TGGTGGTGGACGTGAGCCACGAAGACCCTGAGGTCAAGTTCAACTGGTACGTGGACGGCG
241  ------------+---------+---------+---------+---------+---------+ 300
     ACCACCACCTGCACTCGGTGCTTCTGGGACTCCAGTTCAAGTTGACCATGCACCTGCCGC
c     V  V  D  V  S  H  E  D  P  E  V  K  F  N  W  Y  V  D  G  V -

TGGAGGTGCATAATGCCAAGACAAAGCCGCGGGAGGAGCAGTACAACAGCACGTACCGTG
301  ------------+---------+---------+---------+---------+---------+ 360
     ACCTCCACGTATTACGGTTCTGTTTCGGCGCCCTCCTCGTCATGTTGTCGTGCATGGCAC
c     E  V  H  N  A  K  T  K  P  R  E  E  Q  Y  N  S  T  Y  R  V -

TGGTCAGCGTCCTCACCGTCCTGCACCAGGACTGGCTGAATGGCAAGGAGTACAAGTGCA
361  ------------+---------+---------+---------+---------+---------+ 420
     ACCAGTCGCAGGAGTGGCAGGACGTGGTCCTGACCGACTTACCGTTCCTCATGTTCACGT
c     V  S  V  L  T  V  L  H  Q  D  W  L  N  G  K  E  Y  K  C  K -

AGGTCTCCAACAAAGCCCTCCCAGCCCCCATCGAGAAAACCATCTCCAAAGCCAAAGGGC
421  ------------+---------+---------+---------+---------+---------+ 480
     TCCAGAGGTTGTTTCGGGAGGGTCGGGGGTAGCTCTTTTGGTAGAGGTTTCGGTTTCCCG
c     V  S  N  K  A  L  P  A  P  I  E  K  T  I  S  K  A  K  G  Q -

AGCCCCGAGAACCACAGGTGTACACCCTGCCCCCATCCCGGGATGAGCTGACCAAGAACC
481  ------------+---------+---------+---------+---------+---------+ 540
     TCGGGGCTCTTGGTGTCCACATGTGGGACGGGGGTAGGGCCCTACTCGACTGGTTCTTGG
c     P  R  E  P  Q  V  Y  T  L  P  P  S  R  D  E  L  T  K  N  Q -

AGGTCAGCCTGACCTGCCTGGTCAAAGGCTTCTATCCCAGCGACATCGCCGTGGAGTGGG
541  ------------+---------+---------+---------+---------+---------+ 600
     TCCAGTCGGACTGGACGGACCAGTTTCCGAAGATAGGGTCGCTGTAGCGGCACCTCACCC
c     V  S  L  T  C  L  V  K  G  F  Y  P  S  D  I  A  V  E  W  E -

AGAGCAATGGGCAGCCGGAGAACAACTACAAGACCACGCCTCCCGTGCTGGACTCCGACG
601  ------------+---------+---------+---------+---------+---------+ 660
     TCTCGTTACCCGTCGGCCTCTTGTTGATGTTCTGGTGCGGAGGGCACGACCTGAGGCTGC
c     S  N  G  Q  P  E  N  N  Y  K  T  T  P  P  V  L  D  S  D  G -

GCTCCTTCTTCCTCTACAGCAAGCTCACCGTGGACAAGAGCAGGTGGCAGCAGGGGAACG
661  ------------+---------+---------+---------+---------+---------+ 720
     CGAGGAAGAAGGAGATGTCGTTCGAGTGGCACCTGTTCTCGTCCACCGTCGTCCCCTTGC
c     S  F  F  L  Y  S  K  L  T  V  D  K  S  R  W  Q  Q  G  N  V -

TCTTCTCATGCTCCGTGATGCATGAGGCTCTGCACAACCACTACACGCAGAAGAGCCTCT
721  ------------+---------+---------+---------+---------+---------+ 780
     AGAAGAGTACGAGGCACTACGTACTCCGAGACGTGTTGGTGATGTGCGTCTTCTCGGAGA
c     F  S  C  S  V  M  H  E  A  L  H  N  H  Y  T  Q  K  S  L  S -

BamHI
                |
     CCCTGTCTCCGGGTAAATAATGGATCC
781  ------------+---------+-------  807
     GGGACAGAGGCCCATTTATTACCTAGG
c     L  S  P  G  K  *
```

FIG. 15

```
     XbaI
      |
    TCTAGATTTGAGTTTTAACTTTTAGAAGGAGGAATAAAATATGGGAGGTACTTACTCTTG
  1 ---------+---------+---------+---------+---------+---------+ 60
    AGATCTAAACTCAAAATTGAAAATCTTCCTCCTTATTTTATACCCTCCATGAATGAGAAC
b                                             M  G  G  T  Y  S  C -

CCACTTCGGCCCACTGACTTGGGTTTGCAAACCGCAGGGTGGCGGCGGCGGCGGCGGTGG
 61 ---------+---------+---------+---------+---------+---------+ 120
    GGTGAAGCCGGGTGACTGAACCCAAACGTTTGGCGTCCCACCGCCGCCGCCGCCGCCACC
b    H  F  G  P  L  T  W  V  C  K  P  Q  G  G  G  G  G  G  G  -

TACCTATTCCTGTCATTTTGGCCCGCTGACCTGGGTATGTAAGCCACAAGGGGGTGGGGG
121 ---------+---------+---------+---------+---------+---------+ 180
    ATGGATAAGGACAGTAAAACCGGGCGACTGGACCCATACATTCGGTGTTCCCCCACCCCC
b    T  Y  S  C  H  F  G  P  L  T  W  V  C  K  P  Q  G  G  G  -

AGGCGGGGGGGACAAAACTCACACATGTCCACCTTGCCCAGCACCTGAACTCCTGGGGGG
181 ---------+---------+---------+---------+---------+---------+ 240
    TCCGCCCCCCCTGTTTTGAGTGTGTACAGGTGGAACGGGTCGTGGACTTGAGGACCCCCC
b    G  G  G  D  K  T  H  T  C  P  P  C  P  A  P  E  L  L  G  G -

ACCGTCAGTTTTCCTCTTCCCCCCAAAACCCAAGGACACCCTCATGATCTCCCGGACCCC
241 ---------+---------+---------+---------+---------+---------+ 300
    TGGCAGTCAAAAGGAGAAGGGGGGTTTTGGGTTCCTGTGGGAGTACTAGAGGGCCTGGGG
b    P  S  V  F  L  F  P  P  K  P  K  D  T  L  M  I  S  R  T  P -

TGAGGTCACATGCGTGGTGGTGGACGTGAGCCACGAAGACCCTGAGGTCAAGTTCAACTG
301 ---------+---------+---------+---------+---------+---------+ 360
    ACTCCAGTGTACGCACCACCACCTGCACTCGGTGCTTCTGGGACTCCAGTTCAAGTTGAC
b    E  V  T  C  V  V  V  D  V  S  H  E  D  P  E  V  K  F  N  W -

GTACGTGGACGGCGTGGAGGTGCATAATGCCAAGACAAAGCCGCGGGAGGAGCAGTACAA
361 ---------+---------+---------+---------+---------+---------+ 420
    CATGCACCTGCCGCACCTCCACGTATTACGGTTCTGTTTCGGCGCCCTCCTCGTCATGTT
b    Y  V  D  G  V  E  V  H  N  A  K  T  K  P  R  E  E  Q  Y  N -

CAGCACGTACCGTGTGGTCAGCGTCCTCACCGTCCTGCACCAGGACTGGCTGAATGGCAA
421 ---------+---------+---------+---------+---------+---------+ 480
    GTCGTGCATGGCACACCAGTCGCAGGAGTGGCAGGACGTGGTCCTGACCGACTTACCGTT
b    S  T  Y  R  V  V  S  V  L  T  V  L  H  Q  D  W  L  N  G  K -

GGAGTACAAGTGCAAGGTCTCCAACAAAGCCCTCCCAGCCCCCATCGAGAAAACCATCTC
481 ---------+---------+---------+---------+---------+---------+ 540
    CCTCATGTTCACGTTCCAGAGGTTGTTTCGGGAGGGTCGGGGGTAGCTCTTTTGGTAGAG
b    E  Y  K  C  K  V  S  N  K  A  L  P  A  P  I  E  K  T  I  S -

CAAAGCCAAAGGGCAGCCCCGAGAACCACAGGTGTACACCCTGCCCCCATCCCGGGATGA
541 ---------+---------+---------+---------+---------+---------+ 600
    GTTTCGGTTTCCCGTCGGGGCTCTTGGTGTCCACATGTGGGACGGGGGTAGGGCCCTACT
b    K  A  K  G  Q  P  R  E  P  Q  V  Y  T  L  P  P  S  R  D  E -

GCTGACCAAGAACCAGGTCAGCCTGACCTGCCTGGTCAAAGGCTTCTATCCCAGCGACAT
601 ---------+---------+---------+---------+---------+---------+ 660
    CGACTGGTTCTTGGTCCAGTCGGACTGGACGGACCAGTTTCCGAAGATAGGGTCGCTGTA
b    L  T  K  N  Q  V  S  L  T  C  L  V  K  G  F  Y  P  S  D  I -

CGCCGTGGAGTGGGAGAGCAATGGGCAGCCGGAGAACAACTACAAGACCACGCCTCCCGT
661 ---------+---------+---------+---------+---------+---------+ 720
    GCGGCACCTCACCCTCTCGTTACCCGTCGGCCTCTTGTTGATGTTCTGGTGCGGAGGGCA
b    A  V  E  W  E  S  N  G  Q  P  E  N  N  Y  K  T  T  P  P  V -

GCTGGACTCCGACGGCTCCTTCTTCCTCTACAGCAAGCTCACCGTGGACAAGAGCAGGTG
721 ---------+---------+---------+---------+---------+---------+ 780
    CGACCTGAGGCTGCCGAGGAAGAAGGAGATGTCGTTCGAGTGGCACCTGTTCTCGTCCAC
b    L  D  S  D  G  S  F  F  L  Y  S  K  L  T  V  D  K  S  R  W -

GCAGCAGGGGAACGTCTTCTCATGCTCCGTGATGCATGAGGCTCTGCACAACCACTACAC
781 ---------+---------+---------+---------+---------+---------+ 840
    CGTCGTCCCCTTGCAGAAGAGTACGAGGCACTACGTACTCCGAGACGTGTTGGTGATGTG
b    Q  Q  G  N  V  F  S  C  S  V  M  H  E  A  L  H  N  H  Y  T -

BamHI
                                                        |
    GCAGAAGAGCCTCTCCCTGTCTCCGGGTAAATAATGGATCC
841 ---------+---------+---------+---------+- 881
    CGTCTTCTCGGAGAGGGACAGAGGCCCATTTATTACCTAGG
b    Q  K  S  L  S  L  S  P  G  K  *
```

FIG. 16

```
     XbaI
      |
     TCTAGATTTGTTTTAACTAATTAAAGGAGGAATAACATATGGACAAAACTCACACATGTC
  1  ----------+---------+---------+---------+---------+---------+  60
     AGATCTAAACAAAATTGATTAATTTCCTCCTTATTGTATACCTGTTTTGAGTGTGTACAG
                                          M  D  K  T  H  T  C  P -

CACCTTGCCCAGCACCTGAACTCCTGGGGGGACCGTCAGTTTTCCTCTTCCCCCCAAAAC
 61  ----------+---------+---------+---------+---------+---------+ 120
     GTGGAACGGGTCGTGGACTTGAGGACCCCCCTGGCAGTCAAAAGGAGAAGGGGGGTTTTG
      P  C  P  A  P  E  L  L  G  G  P  S  V  F  L  F  P  P  K  P -

CCAAGGACACCCTCATGATCTCCCGGACCCCTGAGGTCACATGCGTGGTGGTGGACGTGA
121  ----------+---------+---------+---------+---------+---------+ 180
     GGTTCCTGTGGGAGTACTAGAGGGCCTGGGGACTCCAGTGTACGCACCACCACCTGCACT
      K  D  T  L  M  I  S  R  T  P  E  V  T  C  V  V  V  D  V  S -

GCCACGAAGACCCTGAGGTCAAGTTCAACTGGTACGTGGACGGCGTGGAGGTGCATAATG
181  ----------+---------+---------+---------+---------+---------+ 240
     CGGTGCTTCTGGGACTCCAGTTCAAGTTGACCATGCACCTGCCGCACCTCCACGTATTAC
      H  E  D  P  E  V  K  F  N  W  Y  V  D  G  V  E  V  H  N  A -

CCAAGACAAAGCCGCGGGAGGAGCAGTACAACAGCACGTACCGTGTGGTCAGCGTCCTCA
241  ----------+---------+---------+---------+---------+---------+ 300
     GGTTCTGTTTCGGCGCCCTCCTCGTCATGTTGTCGTGCATGGCACACCAGTCGCAGGAGT
      K  T  K  P  R  E  E  Q  Y  N  S  T  Y  R  V  V  S  V  L  T -

CCGTCCTGCACCAGGACTGGCTGAATGGCAAGGAGTACAAGTGCAAGGTCTCCAACAAAG
301  ----------+---------+---------+---------+---------+---------+ 360
     GGCAGGACGTGGTCCTGACCGACTTACCGTTCCTCATGTTCACGTTCCAGAGGTTGTTTC
      V  L  H  Q  D  W  L  N  G  K  E  Y  K  C  K  V  S  N  K  A -

CCCTCCCAGCCCCCATCGAGAAAACCATCTCCAAAGCCAAAGGGCAGCCCCGAGAACCAC
361  ----------+---------+---------+---------+---------+---------+ 420
     GGGAGGGTCGGGGGTAGCTCTTTTGGTAGAGGTTTCGGTTTCCCGTCGGGGCTCTTGGTG
      L  P  A  P  I  E  K  T  I  S  K  A  K  G  Q  P  R  E  P  Q -

AGGTGTACACCCTGCCTCCATCCCGGGATGAGCTGACCAAGAACCAGGTCAGCCTGACCT
421  ----------+---------+---------+---------+---------+---------+ 480
     TCCACATGTGGGACGGAGGTAGGGCCCTACTCGACTGGTTCTTGGTCCAGTCGGACTGGA
      V  Y  T  L  P  P  S  R  D  E  L  T  K  N  Q  V  S  L  T  C -

GCCTGGTCAAAGGCTTCTATCCCAGCGACATCGCCGTGGAGTGGGAGAGCAATGGGCAGC
481  ----------+---------+---------+---------+---------+---------+ 540
     CGGACCAGTTTCCGAAGATAGGGTCGCTGTAGCGGCACCTCACCCTCTCGTTACCCGTCG
      L  V  K  G  F  Y  P  S  D  I  A  V  E  W  E  S  N  G  Q  P -

CGGAGAACAACTACAAGACCACGCCTCCCGTGCTGGACTCCGACGGCTCCTTCTTCCTCT
541  ----------+---------+---------+---------+---------+---------+ 600
     GCCTCTTGTTGATGTTCTGGTGCGGAGGGCACGACCTGAGGCTGCCGAGGAAGAAGGAGA
      E  N  N  Y  K  T  T  P  P  V  L  D  S  D  G  S  F  F  L  Y -

ACAGCAAGCTCACCGTGGACAAGAGCAGGTGGCAGCAGGGGAACGTCTTCTCATGCTCCG
601  ----------+---------+---------+---------+---------+---------+ 660
     TGTCGTTCGAGTGGCACCTGTTCTCGTCCACCGTCGTCCCCTTGCAGAAGAGTACGAGGC
      S  K  L  T  V  D  K  S  R  W  Q  Q  G  N  V  F  S  C  S  V -

TGATGCATGAGGCTCTGCACAACCACTACACGCAGAAGAGCCTCTCCCTGTCTCCGGGTA
661  ----------+---------+---------+---------+---------+---------+ 720
     ACTACGTACTCCGAGACGTGTTGGTGATGTGCGTCTTCTCGGAGAGGGACAGAGGCCCAT
      M  H  E  A  L  H  N  H  Y  T  Q  K  S  L  S  L  S  P  G  K -

AAGGTGGAGGTGGTGGCGGAGGTACTTACTCTTGCCACTTCGGCCCACTGACTTGGGTTT
721  ----------+---------+---------+---------+---------+---------+ 780
     TTCCACCTCCACCACCGCCTCCATGAATGAGAACGGTGAAGCCGGGTGACTGAACCCAAA
      G  G  G  G  G  G  T  Y  S  C  H  F  G  P  L  T  W  V  C -

GCAAACCGCAGGGTGGCGGCGGCGGCGGCGGTGGTACCTATTCCTGTCATTTTGGCCCGC
781  ----------+---------+---------+---------+---------+---------+ 840
     CGTTTGGCGTCCCACCGCCGCCGCCGCCGCCACCATGGATAAGGACAGTAAAACCGGGCG
      K  P  Q  G  G  G  G  G  G  G  T  Y  S  C  H  F  G  P  L -

BamHI
                                              |
     TGACCTGGGTATGTAAGCCACAAGGGGGTTAATCTCGAGGATCC
841  ----------+---------+---------+---------+---- 884
     ACTGGACCCATACATTCGGTGTTCCCCCAATTAGAGCTCCTAGG
      T  W  V  C  K  P  Q  G  G  *
```

FIG. 17A

```
[AatII sticky end]                    5'        GCGTAACGTATGCATGGTCTCC-
(position #4358 in pAMG21)            3' TGCACGCATTGCATACGTACCAGAGG- -CCATGCGAGAGTAGGGAACTGCCAGGCATCAAATAAAACGAAAGGCTCAGTCGAAAGACT-
-GGTACGCTCTCATCCCTTGACGGTCCGTAGTTTATTTTGCTTTCCGAGTCAGCTTTCTGA- -GGGCCTTTCGTTTTATCTGTTGTTTGTCGGTGAACGCTCTCCTGAGTAGGACAAATCCGC-
-CCCGGAAAGCAAAATAGACAACAAACAGCCACTTGCGAGAGGACTCATCCTGTTTAGGCG- -CGGGAGCGGATTTGAACGTTGCGAAGCAACGGCCCGGAGGGTGGCGGGCAGGACGCCCGC-
-GCCCTCGCCTAAACTTGCAACGCTTCGTTGCCGGGCCTCCCACCGCCCGTCCTGCGGGCG- -CATAAACTGCCAGGCATCAAATTAAGCAGAAGGCCATCCTGACGGATGGCCTTTTTGCGT-
-GTATTTGACGGTCCGTAGTTTAATTCGTCTTCCGGTAGGACTGCCTACCGGAAAAACGCA- AatII
-TTCTACAAACTCTTTTGTTTATTTTTCTAAATACATTCAAATATGGACGTCGTACTTAAC-
-AAGATGTTTGAGAAAACAAATAAAAGATTTATGTAAGTTTATACCTGCAGCATGAATTG- -TTTTAAAGTATGGGCAATCAATTGCTCCTGTTAAAATTGCTTTAGAAATACTTTGGCAGC-
-AAAATTTCATACCCGTTAGTTAACGAGGACAATTTTAACGAAATCTTTATGAAACCGTCG- -GGTTGTTGTATTGAGTTTCATTTGCGCATTGGTTAAATGGAAAGTGACCGTGCGCTTAC-
-CCAAACAACATAACTCAAAGTAAACGCGTAACCAATTTACCTTTCACTGGCACGCGAATG- -TACAGCCTAATATTTTTGAAATATCCCAAGAGCTTTTTCCTTCGCATGCCCACGCTAAAC-
-ATGTCGGATTATAAAAACTTTATAGGGTTCTCGAAAAAGGAAGCGTACGGGTGCGATTTG- -ATTCTTTTTCTCTTTTGGTTAAATCGTTGTTTGATTTATTATTTGCTATATTTATTTTTC-
-TAAGAAAAAGAGAAAACCAATTTAGCAACAAACTAAATAATAAACGATATAAATAAAAAG- -GATAATTATCAACTAGAGAAGGAACAATTAATGGTATGTTCATACACGCATGTAAAAATA-
-CTATTAATAGTTGATCTCTTCCTTGTTAATTACCATACAAGTATGTGCGTACATTTTTAT- -AACTATCTATATAGTTGTCTTTCTCTGAATGTGCAAAACTAAGCATTCCGAAGCCATTAT-
-TTGATAGATATATCAACAGAAAGAGACTTACACGTTTTGATTCGTAAGGCTTCGGTAATA- -TAGCAGTATGAATAGGGAAACTAAACCCAGTGATAAGACCTGATGATTTCGCTTCTTTAA-
-ATCGTCATACTTATCCCTTTGATTTGGGTCACTATTCTGGACTACTAAAGCGAAGAAATT- -TTACATTTGGAGATTTTTATTTACAGCATTGTTTTCAAATATATTCCAATTAATCGGTG-
-AATGTAAACCTCTAAAAATAAATGTCGTAACAAAAGTTTATATAAGGTTAATTAGCCAC- -AATGATTGGAGTTAGAATAATCTACTATAGGATCATATTTTATTAAATTAGCGTCATCAT-
-TTACTAACCTCAATCTTATTAGATGATATCCTAGTATAAAATAATTTAATCGCAGTAGTA- -AATATTGCCTCCATTTTTTAGGGTAATTATCCAGAATTGAAATATCAGATTTAACCATAG-
-TTATAACGGAGGTAAAAAATCCCATTAATAGGTCTTAACTTTATAGTCTAAATTGGTATC- -AATGAGGATAAATGATCGCGAGTAAATAATATTCACAATGTACCATTTTAGTCATATCAG-
-TTACTCCTATTTACTAGCGCTCATTTATTATAAGTGTTACATGGTAAATCAGTATAGTC- -ATAAGCATTGATTAATATCATTATTGCTTCTACAGGCTTTAATTTTATTAATTATTCTGT-
-TATTCGTAACTAATTATAGTAATAACGAAGATGTCCGAAATTAAAATAATTAATAAGACA- -AAGTGTCGTCGGCATTTATGTCTTTCATACCCATCTCTTTATCCTTACCTATTGTTTGTC-
-TTCACAGCAGCCGTAAATACAGAAAGTATGGGTAGAGAAATAGGAATGGATAACAAACAG- -GCAAGTTTTGCGTGTTATATATCATTAAAACGGTAATAGATTGACATTTGATTCTAATAA-
-CGTTCAAAACGCACAATATATAGTAATTTTGCCATTATCTAACTGTAAACTAAGATTATT-
```

FIG. 17B

```
-ATTGGATTTTTGTCACACTATTATATCGCTTGAAATACAATTGTTTAACATAAGTACCTG-
-TAACCTAAAAACAGTGTGATAATATAGCGAACTTTATGTTAACAAATTGTATTCATGGAC-

-TAGGATCGTACAGGTTTACGCAAGAAAATGGTTTGTTATAGTCGATTAATCGATTTGATT-
-ATCCTAGCATGTCCAAATGCGTTCTTTTACCAAACAATATCAGCTAATTAGCTAAACTAA-

-CTAGATTTGTTTTAACTAATTAAAGGAGGAATAACATATGGTTAACGCGTTGGAATTCGA-
-GATCTAAACAAAATTGATTAATTTCCTCCTTATTGTATACCAATTGCGCAACCTTAAGCT-

SacII
-GCTCACTAGTGTCGACCTGCAGGGTACCATGGAAGCTTACTCGAGGATCCGCGGAAAGAA-
-CGAGTGATCACAGCTGGACGTCCCATGGTACCTTCGAATGAGCTCCTAGGCGCCTTTCTT-

-GAAGAAGAAGAAGAAAGCCCGAAAGGAAGCTGAGTTGGCTGCTGCCACCGCTGAGCAATA-
-CTTCTTCTTCTTCTTTCGGGCTTTCCTTCGACTCAACCGACGACGGTGGCGACTCGTTAT-

-ACTAGCATAACCCCTTGGGGCCTCTAAACGGGTCTTGAGGGGTTTTTGCTGAAAGGAGG-
-TGATCGTATTGGGGAACCCCGGAGATTTGCCCAGAACTCCCCAAAAAACGACTTTCCTCC-

-AACCGCTCTTCACGCTCTTCACGC 3'         [SacII sticky end]
-TTGGCGAGAAGTGCGAGAAGTG   5'         (position #5904 in pAMG21)
```

FIG. 19A

```
     NdeI
      |
      CATATGGACAAAACTCACACATGTCCACCTTGTCCAGCTCCGGAACTCCTGGGGGGACCG
  1   ---------+---------+---------+---------+---------+---------+  60
      GTATACCTGTTTTGAGTGTGTACAGGTGGAACAGGTCGAGGCCTTGAGGACCCCCCTGGC a         M  D  K  T  H  T  C  P  P  C  P  A  P  E  L  L  G  G  P  -

TCAGTCTTCCTCTTCCCCCCAAAACCCAAGGACACCCTCATGATCTCCCGGACCCCTGAG
 61   ---------+---------+---------+---------+---------+---------+  120
      AGTCAGAAGGAGAAGGGGGGTTTTGGGTTCCTGTGGGAGTACTAGAGGGCCTGGGGACTC a         S  V  F  L  P  P  P  K  P  K  D  T  L  M  I  S  R  T  P  E  -

GTCACATGCGTGGTGGTGGACGTGAGCCACGAAGACCCTGAGGTCAAGTTCAACTGGTAC
121   ---------+---------+---------+---------+---------+---------+  180
      CAGTGTACGCACCACCACCTGCACTCGGTGCTTCTGGGACTCCAGTTCAAGTTGACCATG a         V  T  C  V  V  V  D  V  S  H  E  D  P  E  V  K  F  N  W  Y  -

GTGGACGGCGTGGAGGTGCATAATGCCAAGACAAAGCCGCGGGAGGAGCAGTACAACAGC
181   ---------+---------+---------+---------+---------+---------+  240
      CACCTGCCGCACCTCCACGTATTACGGTTCTGTTTCGGCGCCCTCCTCGTCATGTTGTCG a         V  D  G  V  E  V  H  N  A  K  T  K  P  R  E  E  Q  Y  N  S  -

ACGTACCGTGTGGTCAGCGTCCTCACCGTCCTGCACCAGGACTGGCTGAATGGCAAGGAG
241   ---------+---------+---------+---------+---------+---------+  300
      TGCATGGCACACCAGTCGCAGGAGTGGCAGGACGTGGTCCTGACCGACTTACCGTTCCTC a         T  Y  R  V  V  S  V  L  T  V  L  H  Q  D  W  L  N  G  K  E  -

TACAAGTGCAAGGTCTCCAACAAAGCCCTCCCAGCCCCCATCGAGAAAACCATCTCCAAA
301   ---------+---------+---------+---------+---------+---------+  360
      ATGTTCACGTTCCAGAGGTTGTTTCGGGAGGGTCGGGGGTAGCTCTTTTGGTAGAGGTTT a         Y  K  C  K  V  S  N  K  A  L  P  A  P  I  E  K  T  I  S  K  -

GCCAAAGGGCAGCCCCGAGAACCACAGGTGTACACCCTGCCCCCATCCCGGGATGAGCTG
361   ---------+---------+---------+---------+---------+---------+  420
      CGGTTTCCCGTCGGGGCTCTTGGTGTCCACATGTGGGACGGGGGTAGGGCCCTACTCGAC a         A  K  G  Q  P  R  E  P  Q  V  Y  T  L  P  P  S  R  D  E  L  -

ACCAAGAACCAGGTCAGCCTGACCTGCCTGGTCAAAGGCTTCTATCCCAGCGACATCGCC
421   ---------+---------+---------+---------+---------+---------+  480
      TGGTTCTTGGTCCAGTCGGACTGGACGGACCAGTTTCCGAAGATAGGGTCGCTGTAGCGG a         T  K  N  Q  V  S  L  T  C  L  V  K  G  F  Y  P  S  D  I  A  -

GTGGAGTGGGAGAGCAATGGGCAGCCGGAGAACAACTACAAGACCACGCCTCCCGTGCTG
481   ---------+---------+---------+---------+---------+---------+  540
      CACCTCACCCTCTCGTTACCCGTCGGCCTCTTGTTGATGTTCTGGTGCGGAGGGCACGAC a         V  E  W  E  S  N  G  Q  P  E  N  N  Y  K  T  T  P  P  V  L  -

GACTCCGACGGCTCCTTCTTCCTCTACAGCAAGCTCACCGTGGACAAGAGCAGGTGGCAG
541   ---------+---------+---------+---------+---------+---------+  600
      CTGAGGCTGCCGAGGAAGAAGGAGATGTCGTTCGAGTGGCACCTGTTCTCGTCCACCGTC a         D  S  D  G  S  F  F  L  Y  S  K  L  T  V  D  K  S  R  W  Q  -
```

FIG. 19B

```
        CAGGGGAACGTCTTCTCATGCTCCGTGATGCATGAGGCTCTGCACAACCACTACACGCAG
   601  ------------+---------+---------+---------+---------+---------+ 660
        GTCCCCTTGCAGAAGAGTACGAGGCACTACGTACTCCGAGACGTGTTGGTGATGTGCGTC a        Q  G  N  V  F  S  C  S  V  M  H  E  A  L  H  N  H  Y  T  Q   -

AAGAGCCTCTCCCTGTCTCCGGGTAAAGGTGGAGGTGGTGGTGACTTCCTGCCGCACTAC
   661  ------------+---------+---------+---------+---------+---------+ 720
        TTCTCGGAGAGGGACAGAGGCCCATTTCCACCTCCACCACCACTGAAGGACGGCGTGATG a        K  S  L  S  L  S  P  G  K  G  G  G  G  D  F  L  P  H  Y   -

BamHI
                                                |
        AAAAACACCTCTCTGGGTCACCGTCCGTAATGGATCC
   721  ------------+---------+---------+-------- 757
        TTTTTGTGGAGAGACCCAGTGGCAGGCATTACCTAGG a        K  N  T  S  L  G  H  R  P  *
```

FIG. 20A

```
    NdeI
    |
    CATATGGACTTCCTGCCGCACTACAAAAACACCTCTCTGGGTCACCGTCCGGGTGGAGGC
1   ---------+---------+---------+---------+---------+---------+  60
    GTATACCTGAAGGACGGCGTGATGTTTTTGTGGAGAGACCCAGTGGCAGGCCCACCTCCG a      M  D  F  L  P  H  Y  K  N  T  S  L  G  H  R  P  G  G   -

GGTGGGGACAAAACTCACACATGTCCACCTTGCCCAGCACCTGAACTCCTGGGGGGACCG
61  ---------+---------+---------+---------+---------+---------+  120
    CCACCCCTGTTTTGAGTGTGTACAGGTGGAACGGGTCGTGGACTTGAGGACCCCCCTGGC a      G  G  D  K  T  H  T  C  P  P  C  P  A  P  E  L  L  G  G  P  -

TCAGTTTTCCTCTTCCCCCCAAAACCCAAGGACACCCTCATGATCTCCCGGACCCCTGAG
121 ---------+---------+---------+---------+---------+---------+  180
    AGTCAAAAGGAGAAGGGGGGTTTTGGGTTCCTGTGGGAGTACTAGAGGGCCTGGGGACTC a      S  V  F  L  F  P  P  K  P  K  D  T  L  M  I  S  R  T  P  E  -

GTCACATGCGTGGTGGTGGACGTGAGCCACGAAGACCCTGAGGTCAAGTTCAACTGGTAC
181 ---------+---------+---------+---------+---------+---------+  240
    CAGTGTACGCACCACCACCTGCACTCGGTGCTTCTGGGACTCCAGTTCAAGTTGACCATG a      V  T  C  V  V  V  D  V  S  H  E  D  P  E  V  K  F  N  W  Y  -

GTGGACGGCGTGGAGGTGCATAATGCCAAGACAAAGCCGCGGGAGGAGCAGTACAACAGC
241 ---------+---------+---------+---------+---------+---------+  300
    CACCTGCCGCACCTCCACGTATTACGGTTCTGTTTCGGCGCCCTCCTCGTCATGTTGTCG a      V  D  G  V  E  V  H  N  A  K  T  K  P  R  E  E  Q  Y  N  S  -

ACGTACCGTGTGGTCAGCGTCCTCACCGTCCTGCACCAGGACTGGCTGAATGGCAAGGAG
301 ---------+---------+---------+---------+---------+---------+  360
    TGCATGGCACACCAGTCGCAGGAGTGGCAGGACGTGGTCCTGACCGACTTACCGTTCCTC a      T  Y  R  V  V  S  V  L  T  V  L  H  Q  D  W  L  N  G  K  E  -

TACAAGTGCAAGGTCTCCAACAAAGCCCTCCCAGCCCCCATCGAGAAAACCATCTCCAAA
361 ---------+---------+---------+---------+---------+---------+  420
    ATGTTCACGTTCCAGAGGTTGTTTCGGGAGGGTCGGGGGTAGCTCTTTTGGTAGAGGTTT a      Y  K  C  K  V  S  N  K  A  L  P  A  P  I  E  K  T  I  S  K  -

GCCAAAGGGCAGCCCCGAGAACCACAGGTGTACACCCTGCCCCCATCCCGGGATGAGCTG
421 ---------+---------+---------+---------+---------+---------+  480
    CGGTTTCCCGTCGGGGCTCTTGGTGTCCACATGTGGGACGGGGGTAGGGCCCTACTCGAC a      A  K  G  Q  P  R  E  P  Q  V  Y  T  L  P  P  S  R  D  E  L  -

ACCAAGAACCAGGTCAGCCTGACCTGCCTGGTCAAAGGCTTCTATCCCAGCGACATCGCC
481 ---------+---------+---------+---------+---------+---------+  540
    TGGTTCTTGGTCCAGTCGGACTGGACGGACCAGTTTCCGAAGATAGGGTCGCTGTAGCGG a      T  K  N  Q  V  S  L  T  C  L  V  K  G  F  Y  P  S  D  I  A  -

GTGGAGTGGGAGAGCAATGGGCAGCCGGAGAACAACTACAAGACCACGCCTCCCGTGCTG
541 ---------+---------+---------+---------+---------+---------+  600
    CACCTCACCCTCTCGTTACCCGTCGGCCTCTTGTTGATGTTCTGGTGCGGAGGGCACGAC a      V  E  W  E  S  N  G  Q  P  E  N  N  Y  K  T  T  P  P  V  L  -
```

FIG. 20B

```
        GACTCCGACGGCTCCTTCTTCCTCTACAGCAAGCTCACCGTGGACAAGAGCAGGTGGCAG
   601  ---------+---------+---------+---------+---------+---------+  660
        CTGAGGCTGCCGAGGAAGAAGGAGATGTCGTTCGAGTGGCACCTGTTCTCGTCCACCGTC a         D  S  D  G  S  F  F  L  Y  S  K  L  T  V  D  K  S  R  W  Q  -

CAGGGGAACGTCTTCTCATGCTCCGTGATGCATGAGGCTCTGCACAACCACTACACGCAG
   661  ---------+---------+---------+---------+---------+---------+  720
        GTCCCCTTGCAGAAGAGTACGAGGCACTACGTACTCCGAGACGTGTTGGTGATGTGCGTC a         Q  G  N  V  F  S  C  S  V  M  H  E  A  L  H  N  H  Y  T  Q  -

BamHI
                                               |
        AAGAGCCTCTCCCTGTCTCCGGGTAAATAATGGATCCGCGG
   721  ---------+---------+---------+---------+-  761
        TTCTCGGAGAGGGACAGAGGCCCATTTATTACCTAGGCGCC a         K  S  L  S  L  S  P  G  K  *
```

FIG. 21A

```
     NdeI
     |
     CATATGGACAAAACTCACACATGTCCACCTTGTCCAGCTCCGGAACTCCTGGGGGGACCG
  1  ------------+---------+---------+---------+---------+---------+  60
     GTATACCTGTTTTGAGTGTGTACAGGTGGAACAGGTCGAGGCCTTGAGGACCCCCCTGGC a         M  D  K  T  H  T  C  P  P  C  P  A  P  E  L  L  G  G  P   -

TCAGTCTTCCTCTTCCCCCCAAAACCCAAGGACACCCTCATGATCTCCCGGACCCCTGAG
 61  ------------+---------+---------+---------+---------+---------+ 120
     AGTCAGAAGGAGAAGGGGGGTTTTGGGTTCCTGTGGGAGTACTAGAGGGCCTGGGGACTC a         S  V  F  L  F  P  P  K  P  K  D  T  L  M  I  S  R  T  P  E  -

GTCACATGCGTGGTGGTGGACGTGAGCCACGAAGACCCTGAGGTCAAGTTCAACTGGTAC
121  ------------+---------+---------+---------+---------+---------+ 180
     CAGTGTACGCACCACCACCTGCACTCGGTGCTTCTGGGACTCCAGTTCAAGTTGACCATG a         V  T  C  V  V  V  D  V  S  H  E  D  P  E  V  K  F  N  W  Y  -

GTGGACGGCGTGGAGGTGCATAATGCCAAGACAAAGCCGCGGGAGGAGCAGTACAACAGC
181  ------------+---------+---------+---------+---------+---------+ 240
     CACCTGCCGCACCTCCACGTATTACGGTTCTGTTTCGGCGCCCTCCTCGTCATGTTGTCG a         V  D  G  V  E  V  H  N  A  K  T  K  P  R  E  E  Q  Y  N  S  -

ACGTACCGTGTGGTCAGCGTCCTCACCGTCCTGCACCAGGACTGGCTGAATGGCAAGGAG
241  ------------+---------+---------+---------+---------+---------+ 300
     TGCATGGCACACCAGTCGCAGGAGTGGCAGGACGTGGTCCTGACCGACTTACCGTTCCTC a         T  Y  R  V  V  S  V  L  T  V  L  H  Q  D  W  L  N  G  K  E  -

TACAAGTGCAAGGTCTCCAACAAAGCCCTCCCAGCCCCCATCGAGAAAACCATCTCCAAA
301  ------------+---------+---------+---------+---------+---------+ 360
     ATGTTCACGTTCCAGAGGTTGTTTCGGGAGGGTCGGGGGTAGCTCTTTTGGTAGAGGTTT a         Y  K  C  K  V  S  N  K  A  L  P  A  P  I  E  K  T  I  S  K  -

GCCAAAGGGCAGCCCCGAGAACCACAGGTGTACACCCTGCCCCCATCCCGGGATGAGCTG
361  ------------+---------+---------+---------+---------+---------+ 420
     CGGTTTCCCGTCGGGGCTCTTGGTGTCCACATGTGGGACGGGGGTAGGGCCCTACTCGAC a         A  K  G  Q  P  R  E  P  Q  V  Y  T  L  P  P  S  R  D  E  L  -

ACCAAGAACCAGGTCAGCCTGACCTGCCTGGTCAAAGGCTTCTATCCCAGCGACATCGCC
421  ------------+---------+---------+---------+---------+---------+ 480
     TGGTTCTTGGTCCAGTCGGACTGGACGGACCAGTTTCCGAAGATAGGGTCGCTGTAGCGG a         T  K  N  Q  V  S  L  T  C  L  V  K  G  F  Y  P  S  D  I  A  -

GTGGAGTGGGAGAGCAATGGGCAGCCGGAGAACAACTACAAGACCACGCCTCCCGTGCTG
481  ------------+---------+---------+---------+---------+---------+ 540
     CACCTCACCCTCTCGTTACCCGTCGGCCTCTTGTTGATGTTCTGGTGCGGAGGGCACGAC a         V  E  W  E  S  N  G  Q  P  E  N  N  Y  K  T  T  P  P  V  L  -

GACTCCGACGGCTCCTTCTTCCTCTACAGCAAGCTCACCGTGGACAAGAGCAGGTGGCAG
541  ------------+---------+---------+---------+---------+---------+ 600
     CTGAGGCTGCCGAGGAAGAAGGAGATGTCGTTCGAGTGGCACCTGTTCTCGTCCACCGTC a         D  S  D  G  S  F  F  L  Y  S  K  L  T  V  D  K  S  R  W  Q  -
```

FIG. 21B

```
      CAGGGGAACGTCTTCTCATGCTCCGTGATGCATGAGGCTCTGCACAACCACTACACGCAG
  601 ---------+---------+---------+---------+---------+---------+ 660
      GTCCCCTTGCAGAAGAGTACGAGGCACTACGTACTCCGAGACGTGTTGGTGATGTGCGTC a       Q  G  N  V  F  S  C  S  V  M  H  E  A  L  H  N  H  Y  T  Q   -

AAGAGCCTCTCCCTGTCTCCGGGTAAAGGTGGAGGTGGTGGTTTCGAATGGACCCCGGGT
  661 ---------+---------+---------+---------+---------+---------+ 720
      TTCTCGGAGAGGGACAGAGGCCCATTTCCACCTCCACCACCAAAGCTTACCTGGGGCCCA a       K  S  L  S  L  S  P  G  K  G  G  G  G  F  E  W  T  P  G   -

BamHI
                                          |
      TACTGGCAGCCGTACGCTCTGCCGCTGTAATGGATCCCTCGAG
  721 ---------+---------+---------+---------+--- 763
      ATGACCGTCGGCATGCGAGACGGCGACATTACCTAGGGAGCTC a       Y  W  Q  P  Y  A  L  P  L  *
```

FIG. 22A

```
      NdeI
      |
     CATATGTTCGAATGGACCCCGGGTTACTGGCAGCCGTACGCTCTGCCGCTGGGTGGAGGC
  1  ----------+---------+---------+---------+---------+---------+  60
     GTATACAAGCTTACCTGGGGCCCAATGACCGTCGGCATGCGAGACGGCGACCCACCTCCG a       M  F  E  W  T  P  G  Y  W  Q  P  Y  A  L  P  L  G  G  G   -

GGTGGGGACAAAACTCACACATGTCCACCTTGCCCAGCACCTGAACTCCTGGGGGGACCG
 61  ----------+---------+---------+---------+---------+---------+  120
     CCACCCCTGTTTTGAGTGTGTACAGGTGGAACGGGTCGTGGACTTGAGGACCCCCCTGGC a       G  G  D  K  T  H  T  C  P  P  C  P  A  P  E  L  L  G  G  P  -

TCAGTTTTCCTCTTCCCCCCAAAACCCAAGGACACCCTCATGATCTCCCGGACCCCTGAG
121  ----------+---------+---------+---------+---------+---------+  180
     AGTCAAAAGGAGAAGGGGGGTTTTGGGTTCCTGTGGGAGTACTAGAGGGCCTGGGGACTC a       S  V  F  L  F  P  P  K  P  K  D  T  L  M  I  S  R  T  P  E  -

GTCACATGCGTGGTGGTGGACGTGAGCCACGAAGACCCTGAGGTCAAGTTCAACTGGTAC
181  ----------+---------+---------+---------+---------+---------+  240
     CAGTGTACGCACCACCACCTGCACTCGGTGCTTCTGGGACTCCAGTTCAAGTTGACCATG a       V  T  C  V  V  V  D  V  S  H  E  D  P  E  V  K  F  N  W  Y  -

GTGGACGGCGTGGAGGTGCATAATGCCAAGACAAAGCCGCGGGAGGAGCAGTACAACAGC
241  ----------+---------+---------+---------+---------+---------+  300
     CACCTGCCGCACCTCCACGTATTACGGTTCTGTTTCGGCGCCCTCCTCGTCATGTTGTCG a       V  D  G  V  E  V  H  N  A  K  T  K  P  R  E  E  Q  Y  N  S  -

ACGTACCGTGTGGTCAGCGTCCTCACCGTCCTGCACCAGGACTGGCTGAATGGCAAGGAG
301  ----------+---------+---------+---------+---------+---------+  360
     TGCATGGCACACCAGTCGCAGGAGTGGCAGGACGTGGTCCTGACCGACTTACCGTTCCTC a       T  Y  R  V  V  S  V  L  T  V  L  H  Q  D  W  L  N  G  K  E  -

TACAAGTGCAAGGTCTCCAACAAAGCCCTCCCAGCCCCCATCGAGAAAACCATCTCCAAA
361  ----------+---------+---------+---------+---------+---------+  420
     ATGTTCACGTTCCAGAGGTTGTTTCGGGAGGGTCGGGGGTAGCTCTTTTGGTAGAGGTTT a       Y  K  C  K  V  S  N  K  A  L  P  A  P  I  E  K  T  I  S  K  -

GCCAAAGGGCAGCCCCGAGAACCACAGGTGTACACCCTGCCCCCATCCCGGGATGAGCTG
421  ----------+---------+---------+---------+---------+---------+  480
     CGGTTTCCCGTCGGGGCTCTTGGTGTCCACATGTGGGACGGGGGTAGGGCCCTACTCGAC a       A  K  G  Q  P  R  E  P  Q  V  Y  T  L  P  P  S  R  D  E  L  -

ACCAAGAACCAGGTCAGCCTGACCTGCCTGGTCAAAGGCTTCTATCCCAGCGACATCGCC
481  ----------+---------+---------+---------+---------+---------+  540
     TGGTTCTTGGTCCAGTCGGACTGGACGGACCAGTTTCCGAAGATAGGGTCGCTGTAGCGG a       T  K  N  Q  V  S  L  T  C  L  V  K  G  F  Y  P  S  D  I  A  -

GTGGAGTGGGAGAGCAATGGGCAGCCGGAGAACAACTACAAGACCACGCCTCCCGTGCTG
541  ----------+---------+---------+---------+---------+---------+  600
     CACCTCACCCTCTCGTTACCCGTCGGCCTCTTGTTGATGTTCTGGTGCGGAGGGCACGAC a       V  E  W  E  S  N  G  Q  P  E  N  N  Y  K  T  T  P  P  V  L  -
```

FIG. 22B

```
      GACTCCGACGGCTCCTTCTTCCTCTACAGCAAGCTCACCGTGGACAAGAGCAGGTGGCAG
601   ----------+---------+---------+---------+---------+---------+ 660
      CTGAGGCTGCCGAGGAAGAAGGAGATGTCGTTCGAGTGGCACCTGTTCTCGTCCACCGTC
``` a      D   S   D   G   S   F   F   L   Y   S   K   L   T   V   D   K   S   R   W   Q   -

```
      CAGGGGAACGTCTTCTCATGCTCCGTGATGCATGAGGCTCTGCACAACCACTACACGCAG
661   ----------+---------+---------+---------+---------+---------+ 720
      GTCCCCTTGCAGAAGAGTACGAGGCACTACGTACTCCGAGACGTGTTGGTGATGTGCGTC
``` a      Q   G   N   V   F   S   C   S   V   M   H   E   A   L   H   N   H   Y   T   Q   -

```
                                       BamHI
                                         |
      AAGAGCCTCTCCCTGTCTCCGGGTAAATAATGGATCC
721   ----------+---------+---------+------- 757
      TTCTCGGAGAGGGACAGAGGCCCATTTATTACCTAGG
``` a      K   S   L   S   L   S   P   G   K   *

FIG. 23A

```
     NdeI
     |
     CATATGGACAAAACTCACACATGTCCACCGTGCCCAGCACCTGAACTCCTGGGGGGACCG
  1  ------------+---------+---------+---------+---------+---------+  60
     GTATACCTGTTTTGAGTGTGTACAGGTGGCACGGGTCGTGGACTTGAGGACCCCCCTGGC a        M  D  K  T  H  T  C  P  P  C  P  A  P  E  L  L  G  G  P   -

TCAGTTTTCCTCTTCCCCCCAAAACCCAAGGACACCCTCATGATCTCCCGGACCCCTGAG
  61 ------------+---------+---------+---------+---------+---------+  120
     AGTCAAAAGGAGAAGGGGGGTTTTGGGTTCCTGTGGGAGTACTAGAGGGCCTGGGGACTC a        S  V  F  L  F  P  P  K  P  K  D  T  L  M  I  S  R  T  P  E  -

GTCACATGCGTGGTGGTGGACGTGAGCCACGAAGACCCTGAGGTCAAGTTCAACTGGTAC
 121 ------------+---------+---------+---------+---------+---------+  180
     CAGTGTACGCACCACCACCTGCACTCGGTGCTTCTGGGACTCCAGTTCAAGTTGACCATG a        V  T  C  V  V  V  D  V  S  H  E  D  P  E  V  K  F  N  W  Y  -

GTGGACGGCGTGGAGGTGCATAATGCCAAGACAAAGCCGCGGGAGGAGCAGTACAACAGC
 181 ------------+---------+---------+---------+---------+---------+  240
     CACCTGCCGCACCTCCACGTATTACGGTTCTGTTTCGGCGCCCTCCTCGTCATGTTGTCG a        V  D  G  V  E  V  H  N  A  K  T  K  P  R  E  E  Q  Y  N  S  -

ACGTACCGTGTGGTCAGCGTCCTCACCGTCCTGCACCAGGACTGGCTGAATGGCAAGGAG
 241 ------------+---------+---------+---------+---------+---------+  300
     TGCATGGCACACCAGTCGCAGGAGTGGCAGGACGTGGTCCTGACCGACTTACCGTTCCTC a        T  Y  R  V  V  S  V  L  T  V  L  H  Q  D  W  L  N  G  K  E  -

TACAAGTGCAAGGTCTCCAACAAAGCCCTCCCAGCCCCCATCGAGAAAACCATCTCCAAA
 301 ------------+---------+---------+---------+---------+---------+  360
     ATGTTCACGTTCCAGAGGTTGTTTCGGGAGGGTCGGGGGTAGCTCTTTTGGTAGAGGTTT a        Y  K  C  K  V  S  N  K  A  L  P  A  P  I  E  K  T  I  S  K  -

GCCAAAGGGCAGCCCCGAGAACCACAGGTGTACACCCTGCCCCCATCCCGGGATGAGCTG
 361 ------------+---------+---------+---------+---------+---------+  420
     CGGTTTCCCGTCGGGGCTCTTGGTGTCCACATGTGGGACGGGGGTAGGGCCCTACTCGAC a        A  K  G  Q  P  R  E  P  Q  V  Y  T  L  P  P  S  R  D  E  L  -

ACCAAGAACCAGGTCAGCCTGACCTGCCTGGTCAAAGGCTTCTATCCCAGCGACATCGCC
 421 ------------+---------+---------+---------+---------+---------+  480
     TGGTTCTTGGTCCAGTCGGACTGGACGGACCAGTTTCCGAAGATAGGGTCGCTGTAGCGG a        T  K  N  Q  V  S  L  T  C  L  V  K  G  F  Y  P  S  D  I  A  -

GTGGAGTGGGAGAGCAATGGGCAGCCGGAGAACAACTACAAGACCACGCCTCCCGTGCTG
 481 ------------+---------+---------+---------+---------+---------+  540
     CACCTCACCCTCTCGTTACCCGTCGGCCTCTTGTTGATGTTCTGGTGCGGAGGGCACGAC a        V  E  W  E  S  N  G  Q  P  E  N  N  Y  K  T  T  P  P  V  L  -

GACTCCGACGGCTCCTTCTTCCTCTACAGCAAGCTCACCGTGGACAAGAGCAGGTGGCAG
 541 ------------+---------+---------+---------+---------+---------+  600
     CTGAGGCTGCCGAGGAAGAAGGAGATGTCGTTCGAGTGGCACCTGTTCTCGTCCACCGTC a        D  S  D  G  S  F  F  L  Y  S  K  L  T  V  D  K  S  R  W  Q  -
```

FIG. 23B

```
        CAGGGGAACGTCTTCTCATGCTCCGTGATGCATGAGGCTCTGCACAACCACTACACGCAG
    601 --------+---------+---------+---------+---------+---------+ 660
        GTCCCCTTGCAGAAGAGTACGAGGCACTACGTACTCCGAGACGTGTTGGTGATGTGCGTC a         Q  G  N  V  F  S  C  S  V  M  H  E  A  L  H  N  H  Y  T  Q  -

AAGAGCCTCTCCCTGTCTCCGGGTAAAGGTGGTGGTGGTGGTGTTGAACCGAACTGTGAC
    661 --------+---------+---------+---------+---------+---------+ 720
        TTCTCGGAGAGGGACAGAGGCCCATTTCCACCACCACCACCACAACTTGGCTTGACACTG a         K  S  L  S  L  S  P  G  K  G  G  G  G  V  E  P  N  C  D  -

BamHI
                                                        |
        ATCCATGTTATGTGGGAATGGGAATGTTTTGAACGTCTGTAACTCGAGGATCC
    721 --------+---------+---------+---------+---------+--- 773
        TAGGTACAATACACCCTTACCCTTACAAAACTTGCAGACATTGAGCTCCTAGG a         I  H  V  M  W  E  W  E  C  F  E  R  L  *
```

FIG. 24A

```
       NdeI
       |
       CATATGGTTGAACCGAACTGTGACATCCATGTTATGTGGGAATGGGAATGTTTTGAACGT
    1  ------------+---------+---------+---------+---------+---------+  60
       GTATACCAACTTGGCTTGACACTGTAGGTACAATACACCCTTACCCTTACAAAACTTGCA a         M  V  E  P  N  C  D  I  H  V  M  W  E  W  E  C  F  E  R   -

CTGGGTGGTGGTGGTGGTGACAAAACTCACACATGTCCACCGTGCCCAGCACCTGAACTC
   61  ------------+---------+---------+---------+---------+---------+  120
       GACCCACCACCACCACCACTGTTTTGAGTGTGTACAGGTGGCACGGGTCGTGGACTTGAG a         L  G  G  G  G  D  K  T  H  T  C  P  P  C  P  A  P  E  L   -

CTGGGGGGACCGTCAGTTTTCCTCTTCCCCCCAAAACCCAAGGACACCCTCATGATCTCC
  121  ------------+---------+---------+---------+---------+---------+  180
       GACCCCCCTGGCAGTCAAAAGGAGAAGGGGGGTTTTGGGTTCCTGTGGGAGTACTAGAGG a         L  G  G  P  S  V  F  L  F  P  P  K  P  K  D  T  L  M  I  S   -

CGGACCCCTGAGGTCACATGCGTGGTGGTGGACGTGAGCCACGAAGACCCTGAGGTCAAG
  181  ------------+---------+---------+---------+---------+---------+  240
       GCCTGGGGACTCCAGTGTACGCACCACCACCTGCACTCGGTGCTTCTGGGACTCCAGTTC a         R  T  P  E  V  T  C  V  V  V  D  V  S  H  E  D  P  E  V  K   -

TTCAACTGGTACGTGGACGGCGTGGAGGTGCATAATGCCAAGACAAAGCCGCGGGAGGAG
  241  ------------+---------+---------+---------+---------+---------+  300
       AAGTTGACCATGCACCTGCCGCACCTCCACGTATTACGGTTCTGTTTCGGCGCCCTCCTC a         F  N  W  Y  V  D  G  V  E  V  H  N  A  K  T  K  P  R  E  E   -

CAGTACAACAGCACGTACCGTGTGGTCAGCGTCCTCACCGTCCTGCACCAGGACTGGCTG
  301  ------------+---------+---------+---------+---------+---------+  360
       GTCATGTTGTCGTGCATGGCACACCAGTCGCAGGAGTGGCAGGACGTGGTCCTGACCGAC a         Q  Y  N  S  T  Y  R  V  V  S  V  L  T  V  L  H  Q  D  W  L   -

AATGGCAAGGAGTACAAGTGCAAGGTCTCCAACAAAGCCCTCCCAGCCCCCATCGAGAAA
  361  ------------+---------+---------+---------+---------+---------+  420
       TTACCGTTCCTCATGTTCACGTTCCAGAGGTTGTTTCGGGAGGGTCGGGGGTAGCTCTTT a         N  G  K  E  Y  K  C  K  V  S  N  K  A  L  P  A  P  I  E  K   -

ACCATCTCCAAAGCCAAAGGGCAGCCCCGAGAACCACAGGTGTACACCCTGCCCCCATCC
  421  ------------+---------+---------+---------+---------+---------+  480
       TGGTAGAGGTTTCGGTTTCCCGTCGGGGCTCTTGGTGTCCACATGTGGGACGGGGGTAGG a         T  I  S  K  A  K  G  Q  P  R  E  P  Q  V  Y  T  L  P  P  S   -

CGGGATGAGCTGACCAAGAACCAGGTCAGCCTGACCTGCCTGGTCAAAGGCTTCTATCCC
  481  ------------+---------+---------+---------+---------+---------+  540
       GCCCTACTCGACTGGTTCTTGGTCCAGTCGGACTGGACGGACCAGTTTCCGAAGATAGGG a         R  D  E  L  T  K  N  Q  V  S  L  T  C  L  V  K  G  F  Y  P   -

AGCGACATCGCCGTGGAGTGGGAGAGCAATGGGCAGCCGGAGAACAACTACAAGACCACG
  541  ------------+---------+---------+---------+---------+---------+  600
       TCGCTGTAGCGGCACCTCACCCTCTCGTTACCCGTCGGCCTCTTGTTGATGTTCTGGTGC a         S  D  I  A  V  E  W  E  S  N  G  Q  P  E  N  N  Y  K  T  T   -
```

FIG. 24B

```
      CCTCCCGTGCTGGACTCCGACGGCTCCTTCTTCCTCTACAGCAAGCTCACCGTGGACAAG
  601 --------+---------+---------+---------+---------+---------+ 660
      GGAGGGCACGACCTGAGGCTGCCGAGGAAGAAGGAGATGTCGTTCGAGTGGCACCTGTTC a     P  P  V  L  D  S  D  G  S  F  F  L  Y  S  K  L  T  V  D  K  -

AGCAGGTGGCAGCAGGGGAACGTCTTCTCATGCTCCGTGATGCATGAGGCTCTGCACAAC
  661 --------+---------+---------+---------+---------+---------+ 720
      TCGTCCACCGTCGTCCCCTTGCAGAAGAGTACGAGGCACTACGTACTCCGAGACGTGTTG a     S  R  W  Q  Q  G  N  V  F  S  C  S  V  M  H  E  A  L  H  N  -

BamHI
                                                            |
      CACTACACGCAGAAGAGCCTCTCCCTGTCTCCGGGTAAATAACTCGAGGATCC
  721 --------+---------+---------+---------+---------+--- 773
      GTGATGTGCGTCTTCTCGGAGAGGGACAGAGGCCCATTTATTGAGCTCCTAGG a     H  Y  T  Q  K  S  L  S  L  S  P  G  K  *
```

FIG. 25A

```
     NdeI
     |
     CATATGGACAAAACTCACACATGTCCACCTTGTCCAGCTCCGGAACTCCTGGGGGGACCG
  1  ---------+---------+---------+---------+---------+---------+  60
     GTATACCTGTTTTGAGTGTGTACAGGTGGAACAGGTCGAGGCCTTGAGGACCCCCCTGGC a        M   D   K   T   H   T   C   P   P   C   P   A   P   E   L   L   G   G   P   -

TCAGTCTTCCTCTTCCCCCCAAAACCCAAGGACACCCTCATGATCTCCCGGACCCCTGAG
 61  ---------+---------+---------+---------+---------+---------+ 120
     AGTCAGAAGGAGAAGGGGGGTTTTGGGTTCCTGTGGGAGTACTAGAGGGCCTGGGGACTC a        S   V   F   L   F   P   P   K   P   K   D   T   L   M   I   S   R   T   P   E   -

GTCACATGCGTGGTGGTGGACGTGAGCCACGAAGACCCTGAGGTCAAGTTCAACTGGTAC
121  ---------+---------+---------+---------+---------+---------+ 180
     CAGTGTACGCACCACCACCTGCACTCGGTGCTTCTGGGACTCCAGTTCAAGTTGACCATG a        V   T   C   V   V   V   D   V   S   H   E   D   P   E   V   K   F   N   W   Y   -

GTGGACGGCGTGGAGGTGCATAATGCCAAGACAAAGCCGCGGGAGGAGCAGTACAACAGC
181  ---------+---------+---------+---------+---------+---------+ 240
     CACCTGCCGCACCTCCACGTATTACGGTTCTGTTTCGGCGCCCTCCTCGTCATGTTGTCG a        V   D   G   V   E   V   H   N   A   K   T   K   P   R   E   E   Q   Y   N   S   -

ACGTACCGTGTGGTCAGCGTCCTCACCGTCCTGCACCAGGACTGGCTGAATGGCAAGGAG
241  ---------+---------+---------+---------+---------+---------+ 300
     TGCATGGCACACCAGTCGCAGGAGTGGCAGGACGTGGTCCTGACCGACTTACCGTTCCTC a        T   Y   R   V   V   S   V   L   T   V   L   H   Q   D   W   L   N   G   K   E   -

TACAAGTGCAAGGTCTCCAACAAAGCCCTCCCAGCCCCCATCGAGAAAACCATCTCCAAA
301  ---------+---------+---------+---------+---------+---------+ 360
     ATGTTCACGTTCCAGAGGTTGTTTCGGGAGGGTCGGGGGTAGCTCTTTTGGTAGAGGTTT a        Y   K   C   K   V   S   N   K   A   L   P   A   P   I   E   K   T   I   S   K   -

GCCAAAGGGCAGCCCCGAGAACCACAGGTGTACACCCTGCCCCCATCCCGGGATGAGCTG
361  ---------+---------+---------+---------+---------+---------+ 420
     CGGTTTCCCGTCGGGGCTCTTGGTGTCCACATGTGGGACGGGGGTAGGGCCCTACTCGAC a        A   K   G   Q   P   R   E   P   Q   V   Y   T   L   P   P   S   R   D   E   L   -

ACCAAGAACCAGGTCAGCCTGACCTGCCTGGTCAAAGGCTTCTATCCCAGCGACATCGCC
421  ---------+---------+---------+---------+---------+---------+ 480
     TGGTTCTTGGTCCAGTCGGACTGGACGGACCAGTTTCCGAAGATAGGGTCGCTGTAGCGG a        T   K   N   Q   V   S   L   T   C   L   V   K   G   F   Y   P   S   D   I   A   -

GTGGAGTGGGAGAGCAATGGGCAGCCGGAGAACAACTACAAGACCACGCCTCCCGTGCTG
481  ---------+---------+---------+---------+---------+---------+ 540
     CACCTCACCCTCTCGTTACCCGTCGGCCTCTTGTTGATGTTCTGGTGCGGAGGGCACGAC a        V   E   W   E   S   N   G   Q   P   E   N   N   Y   K   T   T   P   P   V   L   -

GACTCCGACGGCTCCTTCTTCCTCTACAGCAAGCTCACCGTGGACAAGAGCAGGTGGCAG
541  ---------+---------+---------+---------+---------+---------+ 600
     CTGAGGCTGCCGAGGAAGAAGGAGATGTCGTTCGAGTGGCACCTGTTCTCGTCCACCGTC a        D   S   D   G   S   F   F   L   Y   S   K   L   T   V   D   K   S   R   W   Q   -
```

FIG. 25B

```
       CAGGGGAACGTCTTCTCATGCTCCGTGATGCATGAGGCTCTGCACAACCACTACACGCAG
   601 ---------+---------+---------+---------+---------+---------+ 660
       GTCCCCTTGCAGAAGAGTACGAGGCACTACGTACTCCGAGACGTGTTGGTGATGTGCGTC a        Q   G   N   V   F   S   C   S   V   M   H   E   A   L   H   N   H   Y   T   Q   -

AAGAGCCTCTCCCTGTCTCCGGGTAAAGGTGGAGGTGGTGGTTGCACCACCCACTGGGGT
   661 ---------+---------+---------+---------+---------+---------+ 720
       TTCTCGGAGAGGGACAGAGGCCCATTTCCACCTCCACCACCAACGTGGTGGGTGACCCCA

A        K   S   L   S   L   S   P   G   K   G   G   G   G   C   T   T   H   W   G   -

BamHI
                                      |
       TTCACCCTGTGCTAATGGATCCCTCGAG
   721 ---------+---------+-------- 748
       AAGTGGGACACGATTACCTAGGGAGCTC a        F   T   L   C   *
```

FIG. 26A

```
     NdeI
      |
     CATATGTGCACCACCCACTGGGGTTTCACCCTGTGCGGTGGAGGCGGTGGGGACAAAGGT
   1 ---------+---------+---------+---------+---------+---------+ 60
     GTATACACGTGGTGGGTGACCCCAAAGTGGGACACGCCACCTCCGCCACCCCTGTTTCCA a       M  C  T  T  H  W  G  F  T  L  C  G  G  G  G  D  K  G    -

GGAGGCGGTGGGGACAAAACTCACACATGTCCACCTTGCCCAGCACCTGAACTCCTGGGG
  61 ---------+---------+---------+---------+---------+---------+ 120
     CCTCCGCCACCCCTGTTTTGAGTGTGTACAGGTGGAACGGGTCGTGGACTTGAGGACCCC a       G  G  G  G  D  K  T  H  T  C  P  P  C  P  A  P  E  L  L  G  -

GGACCGTCAGTTTTCCTCTTCCCCCCAAAACCCAAGGACACCCTCATGATCTCCCGGACC
 121 ---------+---------+---------+---------+---------+---------+ 180
     CCTGGCAGTCAAAAGGAGAAGGGGGGTTTTGGGTTCCTGTGGGAGTACTAGAGGGCCTGG a       G  P  S  V  F  L  F  P  P  K  P  K  D  T  L  M  I  S  R  T  -

CCTGAGGTCACATGCGTGGTGGTGGACGTGAGCCACGAAGACCCTGAGGTCAAGTTCAAC
 181 ---------+---------+---------+---------+---------+---------+ 240
     GGACTCCAGTGTACGCACCACCACCTGCACTCGGTGCTTCTGGGACTCCAGTTCAAGTTG a       P  E  V  T  C  V  V  V  D  V  S  H  E  D  P  E  V  K  F  N  -

TGGTACGTGGACGGCGTGGAGGTGCATAATGCCAAGACAAAGCCGCGGGAGGAGCAGTAC
 241 ---------+---------+---------+---------+---------+---------+ 300
     ACCATGCACCTGCCGCACCTCCACGTATTACGGTTCTGTTTCGGCGCCCTCCTCGTCATG a       W  Y  V  D  G  V  E  V  H  N  A  K  T  K  P  R  E  E  Q  Y  -

AACAGCACGTACCGTGTGGTCAGCGTCCTCACCGTCCTGCACCAGGACTGGCTGAATGGC
 301 ---------+---------+---------+---------+---------+---------+ 360
     TTGTCGTGCATGGCACACCAGTCGCAGGAGTGGCAGGACGTGGTCCTGACCGACTTACCG a       N  S  T  Y  R  V  V  S  V  L  T  V  L  H  Q  D  W  L  N  G  -

AAGGAGTACAAGTGCAAGGTCTCCAACAAAGCCCTCCCAGCCCCCATCGAGAAAACCATC
 361 ---------+---------+---------+---------+---------+---------+ 420
     TTCCTCATGTTCACGTTCCAGAGGTTGTTTCGGGAGGGTCGGGGGTAGCTCTTTTGGTAG a       K  E  Y  K  C  K  V  S  N  K  A  L  P  A  P  I  E  K  T  I  -

TCCAAAGCCAAAGGGCAGCCCCGAGAACCACAGGTGTACACCCTGCCCCCATCCCGGGAT
 421 ---------+---------+---------+---------+---------+---------+ 480
     AGGTTTCGGTTTCCCGTCGGGGCTCTTGGTGTCCACATGTGGGACGGGGGTAGGGCCCTA a       S  K  A  K  G  Q  P  R  E  P  Q  V  Y  T  L  P  P  S  R  D  -

GAGCTGACCAAGAACCAGGTCAGCCTGACCTGCCTGGTCAAAGGCTTCTATCCCAGCGAC
 481 ---------+---------+---------+---------+---------+---------+ 540
     CTCGACTGGTTCTTGGTCCAGTCGGACTGGACGGACCAGTTTCCGAAGATAGGGTCGCTG a       E  L  T  K  N  Q  V  S  L  T  C  L  V  K  G  F  Y  P  S  D  -

ATCGCCGTGGAGTGGGAGAGCAATGGGCAGCCGGAGAACAACTACAAGACCACGCCTCCC
 541 ---------+---------+---------+---------+---------+---------+ 600
     TAGCGGCACCTCACCCTCTCGTTACCCGTCGGCCTCTTGTTGATGTTCTGGTGCGGAGGG a       I  A  V  E  W  E  S  N  G  Q  P  E  N  N  Y  K  T  T  P  P  -
```

FIG. 26B

```
         GTGCTGGACTCCGACGGCTCCTTCTTCCTCTACAGCAAGCTCACCGTGGACAAGAGCAGG
    601  ---------+---------+---------+---------+---------+---------+ 660
         CACGACCTGAGGCTGCCGAGGAAGAAGGAGATGTCGTTCGAGTGGCACCTGTTCTCGTCC a         V  L  D  S  D  G  S  F  F  L  Y  S  K  L  T  V  D  K  S  R  -

TGGCAGCAGGGGAACGTCTTCTCATGCTCCGTGATGCATGAGGCTCTGCACAACCACTAC
    661  ---------+---------+---------+---------+---------+---------+ 720
         ACCGTCGTCCCCTTGCAGAAGAGTACGAGGCACTACGTACTCCGAGACGTGTTGGTGATG a         W  Q  Q  G  N  V  F  S  C  S  V  M  H  E  A  L  H  N  H  Y  -

BamHI
                                                         |
         ACGCAGAAGAGCCTCTCCCTGTCTCCGGGTAAATAATGGATCC
    721  ---------+---------+---------+---------+--- 763
         TGCGTCTTCTCGGAGAGGGACAGAGGCCCATTTATTACCTAGG a         T  Q  K  S  L  S  L  S  P  G  K  *
```

MODIFIED PEPTIDES AS THERAPEUTIC AGENTS

CROSS-REFERENCE TO RELATED APPLICATIONS

This applications claims the benefit of U.S. Provisional application No. 60/105,371, filed Oct. 23, 1998.

BACKGROUND OF THE INVENTION

Recombinant proteins are an emerging class of therapeutic agents. Such recombinant therapeutics have engendered advances in protein formulation and chemical modification. Such modifications can protect therapeutic proteins, primarily by blocking their exposure to proteolytic enzymes. Protein modifications may also increase the therapeutic protein's stability, circulation time, and biological activity. A review article describing protein modification and fusion proteins is Francis (1992), Focus on Growth Factors 3:4–10 (Mediscript, London), which is hereby incorporated by reference.

One useful modification is combination with the "Fc" domain of an antibody. Antibodies comprise two functionally independent parts, a variable domain known as "Fab", which binds antigen, and a constant domain known as "Fc", which links to such effector functions as complement activation and attack by phagocytic cells. An Fc has a long serum half-life, whereas an Fab is short-lived. Capon et al. (1989), Nature 337: 525–31. When constructed together with a therapeutic protein, an Fc domain can provide longer half-life or incorporate such functions as Fc receptor binding, protein A binding, complement fixation and perhaps even placental transfer. Id. Table 1 summarizes use of Fc fusions known in the art.

relatively large interface. However, as demonstrated for human growth hormone and its receptor, only a few key residues at the interface contribute to most of the binding energy. Clackson et al. (1995), Science 267: 383–6. The bulk of the protein ligand merely displays the binding epitopes in the right topology or serves functions unrelated to binding. Thus, molecules of only "peptide" length (2 to 40 amino acids) can bind to the receptor protein of a given large protein ligand. Such peptides may mimic the bioactivity of the large protein ligand ("peptide agonists") or, through competitive binding, inhibit the bioactivity of the large protein ligand ("peptide antagonists").

Phage display peptide libraries have emerged as a powerful method in identifying such peptide agonists and antagonists. See, for example, Scott et al. (1990), Science 249: 386; Devlin et al. (1990), Science 249: 404; U.S. Pat. No. 5,223,409, issued Jun. 29, 1993; U.S. Pat. No. 5,733,731, issued Mar. 31, 1998; U.S. Pat. No. 5,498,530, issued Mar. 12, 1996; U.S. Pat. No. 5,432,018, issued Jul. 11, 1995; U.S. Pat. No. 5,338,665, issued Aug. 16, 1994; U.S. Pat. No. 5,922,545, issued Jul. 13, 1999; WO 96/40987, published Dec. 19, 1996; and WO 98/15833, published Apr. 16, 1998 (each of which is incorporated by reference). In such libraries, random peptide sequences are displayed by fusion with coat proteins of filamentous phage. Typically, the displayed peptides are affinity-eluted against an antibody-immobilized extracellular domain of a receptor. The retained phages may be enriched by successive rounds of affinity purification and repropagation. The best binding peptides may be sequenced to identify key residues within one or more structurally related families of peptides. See, e.g., Cwirla et al. (1997), Science 276: 1696–9, in which two distinct families were identified. The peptide sequences may also suggest which residues may be safely replaced by alanine scanning or by mutagenesis at the DNA level.

TABLE 1

Fc fusion with therapeutic proteins

| Form of Fc | Fusion partner | Therapeutic implications | Reference |
|---|---|---|---|
| IgG1 | N-terminus of CD30-L | Hodgkin's disease; anaplastic lymphoma; T-cell leukemia | U.S. Pat. No. 5,480,981 |
| Murine Fcγ2a | IL-10 | anti-inflammatory; transplant rejection | Zheng et al. (1995), J. Immunol. 154: 5590–600 |
| IgG1 | TNF receptor | septic shock | Fisher et al. (1996), N. Engl. J. Med. 334: 1697–1702; Van Zee, K. et al. (1996), J. Immunol. 156: 2221–30 |
| IgG, IgA, IgM, or IgE (excluding the first domain) | TNF receptor | inflammation, autoimmune disorders | U.S. Pat. No. 5,808,029, issued September 15, 1998 |
| IgG1 | CD4 receptor | AIDS | Capon et al. (1989), Nature 337: 525–31 |
| IgG1, IgG3 | N-terminus of IL-2 | anti-cancer, antiviral | Harvill et al. (1995), Immunotech. 1: 95–105 |
| IgG1 | C-terminus of OPG | osteoarthritis; bone density | WO 97/23614, published July 3, 1997 |
| IgG1 | N-terminus of leptin | anti-obesity | PCT/US 97/23183, filed December 11, 1997 |
| Human Ig Cγ1 | CTLA-4 | autoimmune disorders | Linsley (1991), J. Exp. Med. 174:561–9 |

A much different approach to development of therapeutic agents is peptide library screening. The interaction of a protein ligand with its receptor often takes place at a Mutagenesis libraries may be created and screened to further optimize the sequence of the best binders. Lowman (1997), Ann. Rev. Biophys. Biomol. Struct. 26: 401–24.

Structural analysis of protein-protein interaction may also be used to suggest peptides that mimic the binding activity of large protein ligands. In such an analysis, the crystal structure may suggest the identity and relative orientation of critical residues of the large protein ligand, from which a peptide may be designed. See, e.g., Takasaki et al. (1997), *Nature Biotech.* 15: 1266–70. These analytical methods may also be used to investigate the interaction between a receptor protein and peptides selected by phage display, which may suggest further modification of the peptides to increase binding affinity.

Other methods compete with phage display in peptide research. A peptide library can be fused to the carboxyl terminus of the lac repressor and expressed in *E. coli*. Another *E. coli*-based method allows display on the cell's outer membrane by fusion with a peptidoglycan-associated lipoprotein (PAL). Hereinafter, these and related methods are collectively referred to as "*E. coli* display." In another method, translation of random RNA is halted prior to ribosome release, resulting in a library of polypeptides with their associated RNA still attached. Hereinafter, this and related methods are collectively referred to as "ribosome display." Other methods employ chemical linkage of peptides to RNA; see, for example, Roberts & Szostak (1997), *Proc. Natl. Acad. Sci. USA*, 94:12297–303. Hereinafter, this and related methods are collectively referred to as "RNA-peptide screening." Chemically derived peptide libraries have been developed in which peptides are immobilized on stable, non-biological materials, such as polyethylene rods or solvent-permeable resins. Another chemically derived peptide library uses photolithography to scan peptides immobilized on glass slides. Hereinafter, these and related methods are collectively referred to as "chemical-peptide screening." Chemical-peptide screening may be advantageous in that it allows use of D-amino acids and other unnatural analogues, as well as non-peptide elements. Both biological and chemical methods are reviewed in Wells & Lowman (1992), *Curr. Opin. Biotechnol.* 3: 355–62.

Conceptually, one may discover peptide mimetics of any protein using phage display and the other methods mentioned above. These methods have been used for epitope mapping, for identification of critical amino acids in protein-protein interactions, and as leads for the discovery of new therapeutic agents. E.g., Cortese et al. (1996), *Curr. Opin. Biotech.* 7: 616–21. Peptide libraries are now being used most often in immunological studies, such as epitope mapping. Kreeger (1996), *The Scientist* 10(13): 19–20.

Of particular interest here is use of peptide libraries and other techniques in the discovery of pharmacologically active peptides. A number of such peptides identified in the art are summarized in Table 2. The peptides are described in the listed publications, each of which is hereby incorporated by reference. The pharmacologic activity of the peptides is described, and in many instances is followed by a shorthand term therefor in parentheses. Some of these peptides have been modified (e.g., to form C-terminally cross-linked dimers). Typically, peptide libraries were screened for binding to a receptor for a pharmacologically active protein (e.g., EPO receptor). In at least one instance (CTLA4), the peptide library was screened for binding to a monclonal antibody.

TABLE 2

Pharmacologically active peptides

| Form of peptide | Binding partner/ protein of interest[a] | Pharmacologic activity | Reference |
|---|---|---|---|
| intrapeptide disulfide-bonded | EPO receptor | EPO-mimetic | Wrighton et al. (1996), Science 273: 458–63; U.S. Pat. No. 5,773,569, issued June 30, 1998 to Wrighton et al. |
| C-terminally cross-linked dimer | EPO receptor | EPO-mimetic | Livnah et al. (1996), Science 273: 464–71; Wrighton et al. (1997), Nature Biotechnology 15: 1261–5; International patent application WO 96/40772, published Dec. 19, 1996 |
| linear | EPO receptor | EPO-mimetic | Naranda et al. (1999), Proc. Natl. Acad. Sci. USA, 96: 7569–74 |
| linear | c-Mpl | TPO-mimetic | Cwirla et al. (1997) Science 276: 1696–9; U.S. Pat. No. 5,869,451, issued Feb. 9, 1999; U.S. Pat. No. 5,932,946, issued Aug. 3, 1999 |
| C-terminally cross-linked dimer | c-Mpl | TPO-mimetic | Cwirla et al. (1997), Science 276: 1696–9 |
| disulfide-linked dimer | | stimulation of hematopoiesis ("G-CSF-mimetic") | Paukovits et al. (1984), Hoppe-Seylers Z. Physiol. Chem. 365: 303–11; Laerum et al. (1988), Exp. Hemat. 16: 274–80 |
| akylene-linked dimer | | G-CSF-mimetic | Bhatnagar et al. (1996), J. Med. Chem. 39: 3814–9; Cuthbertson et al. |

TABLE 2-continued

Pharmacologically active peptides

| Form of peptide | Binding partner/ protein of interest[a] | Pharmacologic activity | Reference |
|---|---|---|---|
| | | | (1997), J. Med. Chem. 40: 2876–82; King et al. (1991), Exp. Hematol. 19:481; King et al. (1995), Blood 86 (Suppl. 1): 309a |
| linear | IL-1 receptor | inflammatory and autoimmune diseases ("IL-1 antagonist" or "IL-1ra-mimetic") | U.S. Pat. No. 5,608,035; U.S. Pat. No. 5,786,331; U.S. Pat. No. 5,880,096; Yanofsky et al. (1996), Proc. Natl. Acad. Sci. 93: 7381–6; Akeson et al. (1996), J. Biol. Chem. 271: 30517–23; Wiekzorek et al. (1997), Pol. J. Pharmacol. 49: 107–17; Yanofsky (1996), PNAs, 93:7381–7386. |
| linear | Facteur thymique serique (FTS) | stimulation of lymphocytes ("FTS-mimetic") | Inagaki-Ohara et al. (1996), Cellular Immunol. 171: 30–40; Yoshida (1984), Int. J. Immunopharmacol, 6:141–6. |
| intrapeptide disulfide bonded | CTLA4 MAb | CTLA4-mimetic | Fukumoto et al. (1998), Nature Biotech. 16: 267–70 |
| exocyclic | TNF-α receptor | TNF-α antagonist | Takasaki et al. (1997), Nature Biotech. 15:1266–70; WO 98/53842, published December 3, 1998 |
| linear | TNF-α receptor | TNF-α antagonist | Chirinos-Rojas ( ), J. Imm., 5621–5626. |
| intrapeptide disulfide bonded | C3b | inhibition of complement activation; autoimmune diseases ("C3b-antagonist") | Sahu et al. (1996), J. Immunol. 157: 884–91; Morikis et al. (1998), Protein Sci. 7: 619–27 |
| linear | vinculin | cell adhesion processes- cell growth, differentiation, wound healing, tumor metastasis ("vinculin binding") | Adey et al. (1997), Biochem. J. 324: 523–8 |
| linear | C4 binding protein (C4BP) | anti-thrombotic | Linse et al. (1997), J. Biol. Chem. 272: 14658–65 |
| linear | urokinase receptor | processes associated with urokinase interaction with its receptor (e.g., angiogenesis, tumor cell invasion and metastasis); ("UKR antagonist") | Goodson et al. (1994), Proc Natl. Acad. Sci. 91: 7129–33; International application WO 97/35969, published October 2, 1997 |
| linear | Mdm2, Hdm2 | Inhibition of inactivation of p53 mediated by Mdm2 or hdm2; anti-tumor ("Mdm/hdm antagonist") | Picksley et al. (1994), Oncogene 9: 2523–9; Bottger et al. (1997) J. Mol. Biol. 269: 744–56; Bottger et al. (1996), Oncogene 13: 2141–7 |
| linear | p21$^{WAF1}$ | anti-tumor by mimicking the activity of p21$^{WAF1}$ | Ball et al. (1997), Curr. Biol. 7: 71–80 |
| linear | farnesyl transferase | anti-cancer by preventing activation of ras oncogene | Gibbs et al. (1994), Cell 77:175–178 |
| linear | Ras effector domain | anti-cancer by inhibiting biological function of the ras oncogene | Moodie et al. (1994), Trends Genet 10: 44–48 Rodriguez et al. (1994), Nature 370:527–532 |
| linear | SH2/SH3 domains | anti-cancer by inhibiting tumor growth with activated tyrosine kinases | Pawson et al. (1993), Curr. Biol. 3:434–432 Yu et al. (1994), Cell 76:933–945 |
| linear | p16$^{INK4}$ | anti-cancer by mimicking activity of p16; e.g., | Fahraeus et al. (1996), Curr. Biol. 6:84–91 |

TABLE 2-continued

Pharmacologically active peptides

| Form of peptide | Binding partner/ protein of interest[a] | Pharmacologic activity | Reference |
|---|---|---|---|
| linear | Src, Lyn | inhibiting cyclin D-Cdk complex ("p16-mimetic") inhibition of Mast cell activation, IgE-related conditions, type I hypersensitivity ("Mast cell antagonist") | Stauffer et al. (1997), Biochem. 36: 9388–94 |
| linear | Mast cell protease | treatment of inflammatory disorders mediated by release of tryptase-6 ("Mast cell protease inhibitors") | International application WO 98/33812, published August 6, 1998 |
| linear | SH3 domains | treatment of SH3-mediated disease states ("SH3 antagonist") | Rickles et al. (1994), EMBO J. 13: 5598–5604; Sparks et al. (1994), J. Biol. Chem. 269: 23853–6; Sparks et al. (1996), Proc. Natl. Acad. Sci. 93: 1540–4 |
| linear | HBV core antigen (HBcAg) | treatment of HBV viral infections ("anti-HBV") | Dyson & Muray (1995), Proc. Natl. Acad. Sci. 92: 2194–8 |
| linear | selectins | neutrophil adhesion; inflammatory diseases ("selectin antagonist") | Martens et al. (1995), J. Biol. Chem. 270: 21129–36; European patent application EP 0 714 912, published June 5, 1996 |
| linear, cyclized | calmodulin | calmodulin antagonist | Pierce et al. (1995), Molec. Diversity 1: 259–65; Dedman et al. (1993), J. Biol. Chem. 268: 23025–30; Adey & Kay (1996), Gene 169: 133–4 |
| linear, cyclized- | integrins | tumor-homing; treatment for conditions related to integrin-mediated cellular events, including platelet aggregation, thrombosis, wound healing, osteoporosis, tissue repair, angiogenesis (e.g., for treatment of cancer), and tumor invasion ("integrin-binding") | International applications WO 95/14714, published June 1, 1995; WO 97/08203, published March 6, 1997; WO 98/10795, published March 19, 1998; WO 99/24462, published May 20, 1999; Kratt et al. (1999), J. Biol. Chem. 274: 1979–1985 |
| cyclic, linear | fibronectin and extracellular matrix components of T cells and macrophages | treatment of inflammatory and autoimmune conditions | WO 98/09985, published March 12, 1998 |
| linear | somatostatin and cortistatin | treatment or prevention of hormone-producing tumors, acromegaly, giantism, dementia, gastric ulcer, tumor growth, inhibition of hormone secretion, modulation of sleep or neural activity | European patent application 0 911 393, published April 28, 1999 |
| linear | bacterial lipopolysaccharide | antibiotic; septic shock; disorders modulatable by CAP37 | U.S. Pat. No. 5,877,151, issued March 2, 1999 |
| linear or cyclic, including D-amino acids | pardaxin, mellitin | antipathogenic | WO 97/31019, published 28 August 1997 |
| linear, cyclic | VIP | impotence, neurodegenerative disorders | WO 97/40070, published October 30, 1997 |

TABLE 2-continued

Pharmacologically active peptides

| Form of peptide | Binding partner/ protein of interest[a] | Pharmacologic activity | Reference |
|---|---|---|---|
| linear | CTLs | cancer | EP 0 770 624, published May 2, 1997 |
| linear | THF-gamma2 | | Burnstein (1988), Biochem., 27:4066–71. |
| linear | Amylin | | Cooper (1987), Proc. Natl. Acad. Sci., 84:8628–32. |
| linear | Adrenomedullin | | Kitamura (1993), BBRC, 192:553–60. |
| cyclic, linear | VEGF | anti-angiogenic; cancer, rheumatoid arthritis, diabetic retinopathy, psoriasis ("VEGF antagonist") | Fairbrother (1998), Biochem., 37:17754–17764. |
| cyclic | MMP | inflammation and autoimmune disorders; tumor growth ("MMP inhibitor") | Koivunen (1999), Nature Biotech., 17:768–774. |
| | HGH fragment | | U.S. Pat. No. 5,869,452 |
| | Echistatin | inhibition of platelet aggregation | Gan (1988), J. Biol. Chem., 263:19827–32. |
| linear | SLE autoantibody | SLE | WO 96/30057, published October 3, 1996 |
| | GD1alpha | suppression of tumor metastasis | Ishikawa et al. (1998), FEBS Lett. 441 (1): 20–4 |
| | antiphospholipid beta-2-glycoprotein-I (β2GPI) antibodies | endothelial cell activation, antiphospholipid syndrome (APS), thromboembolic phenomena, thrombocytopenia, and recurrent fetal loss | Blank et al. (1999), Proc. Natl. Acad. Sci. USA 96: 5164–8 |
| linear | T Cell Receptor beta chain | diabetes | WO 96/11214, published April 18, 1996 |

[a]The protein listed in this column may be bound by the associated peptide (e.g., EPO receptor, IL-1 receptor) or mimicked by the associated peptide. The references listed for each clarity whether the molecule is bound by or mimicked by the peptides.
[b]FTS is a thymic hormone mimicked by the molecule of this invention rather than a receptor bound by the molecule of this invention.

Peptides identified by peptide library screening have been regarded as "leads" in development of therapeutic agents rather than as therapeutic agents themselves. Like other proteins and peptides, they would be rapidly removed in vivo either by renal filtration, cellular clearance mechanisms in the reticuloendothelial system, or proteolytic degradation. Francis (1992), *Focus on Growth Factors* 3: 4–11. As a result, the art presently uses the identified peptides to validate drug targets or as scaffolds for design of organic compounds that might not have been as easily or as quickly identified through chemical library screening. Lowman (1997), *Ann. Rev. Biophys. Biomol. Struct.* 26: 401–24; Kay et al. (1998), *Drug Disc. Today* 3: 370–8. The art would benefit from a process by which such peptides could more readily yield therapeutic agents.

SUMMARY OF THE INVENTION

The present invention concerns a process by which the in vivo half-life of one or more biologically active peptides is increased by fusion with a vehicle. In this invention, pharmacologically active compounds are prepared by a process comprising:

a) selecting at least one peptide that modulates the activity of a protein of interest; and
b) preparing a pharmacologic agent comprising at least one vehicle covalently linked to at least one amino acid sequence of the selected peptide.

The preferred vehicle is an Fc domain. The peptides screened in step (a) are preferably expressed in a phage display library. The vehicle and the peptide may be linked through the N- or C-terminus of the peptide or the vehicle, as described further below. Derivatives of the above compounds (described below) are also encompassed by this invention.

The compounds of this invention may be prepared by standard synthetic methods, recombinant DNA techniques, or any other methods of preparing peptides and fusion proteins. Compounds of this invention that encompass non-peptide portions may be synthesized by standard organic chemistry reactions, in addition to standard peptide chemistry reactions when applicable.

The primary use contemplated is as therapeutic or prophylactic agents. The vehicle-linked peptide may have activity comparable to—or even greater than—the natural ligand mimicked by the peptide. In addition, certain natural ligand-based therapeutic agents might induce antibodies against the patient's own endogenous ligand; the vehicle-linked peptide avoids this pitfall by having little or typically no sequence identity with the natural ligand.

Although mostly contemplated as therapeutic agents, compounds of this invention may also be useful in screening for such agents. For example, one could use an Fc-peptide (e.g., Fc-SH2 domain peptide) in an assay employing anti- Fc coated plates. The vehicle, especially Fc, may make insoluble peptides soluble and thus useful in a number of assays.

The compounds of this invention may be used for therapeutic or prophylactic purposes by formulating them with appropriate pharmaceutical carrier materials and administering an effective amount to a patient, such as a human (or other mammal) in need thereof. Other related aspects are also included in the instant invention. dr Numerous additional aspects and advantages of the present invention will become apparent upon consideration of the figures and detailed description of the invention.

BRIEF DESCRIPTION OF THE FIGURES

- A, D: Single disulfide-bonded dimers. IgG1 antibodies typically have two disulfide bonds at the hinge region between the constant and variable domains. The Fc domain in FIGS. 2A and 2D may be formed by truncation between the two disulfide bond sites or by substitution of a cysteinyl residue with an unreactive residue (e.g., alanyl).

FIG. 4 shows exemplary nucleic acid and amino acid sequences (SEQ ID NOS: 1 and 2, respectively) of human IgG1 Fc that may be used in this invention.

FIG. 7 shows the nucleotide and amino acid sequences (SEQ ID NOS: 5 and 6, respectively) of the molecule identified as "Fc-TMP" in Example 2 hereinafter.

FIG. 8 shows the nucleotide and amino acid sequences (SEQ. ID. NOS: 7 and 8, respectively) of the molecule identified as "Fc-TMP-TMP" in Example 2 hereinafter.

FIG. 9 shows the nucleotide and amino acid sequences (SEQ. ID. NOS: 9 and 10, respectively) of the molecule identified as "TMP-TMP-Fc" in Example 2 hereinafter.

FIG. 10 shows the nucleotide and amino acid sequences (SEQ. ID. NOS: 11 and 12, respectively) of the molecule identified as "TMP-Fc" in Example 2 hereinafter.

FIG. 11 shows the number of platelets generated in vivo in normal female BDF1 mice treated with one 100 μg/kg bolus injection of various compounds, with the terms defined as follows.

Figure 6:
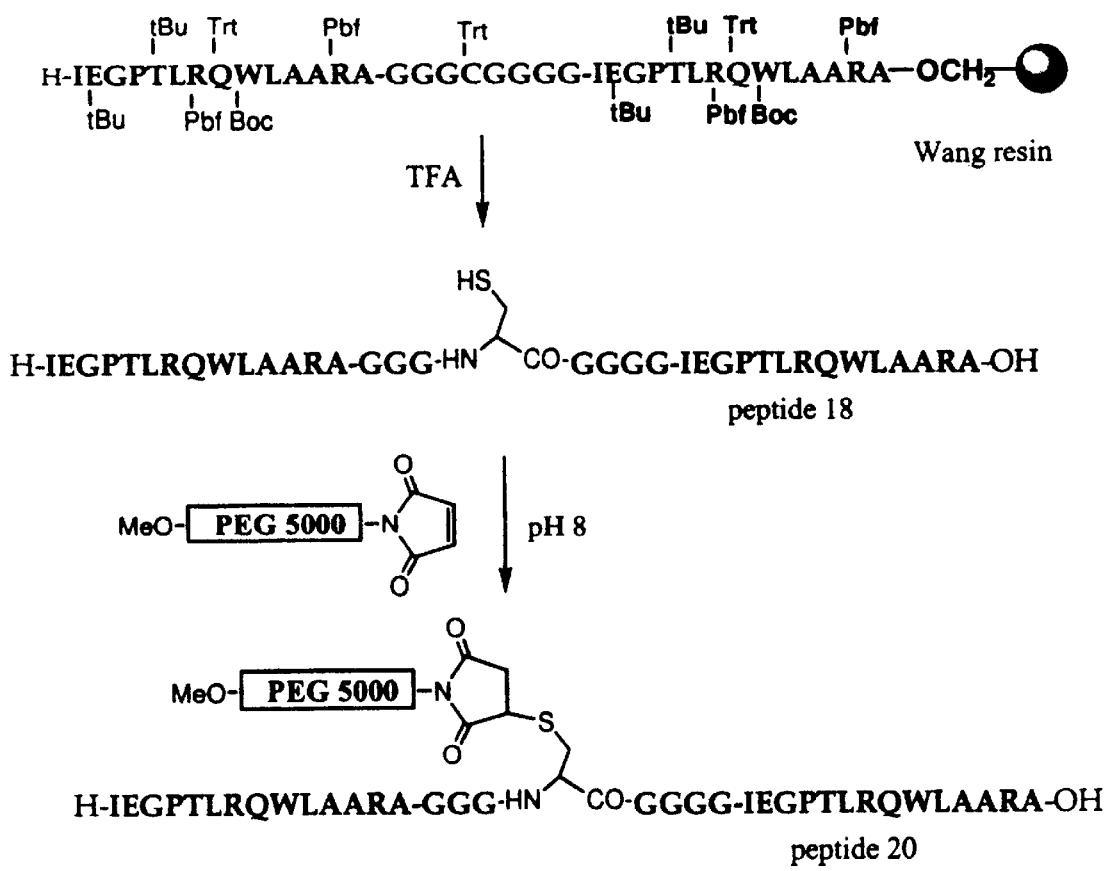
FIG. 6 shows a synthetic scheme for the preparation of PEGylated peptide 20 (SEQ ID NO: 4) as prepared through intermediates having SEQ ID NOS: 1132 and 1133, respectively.
Figures 1, 18A:
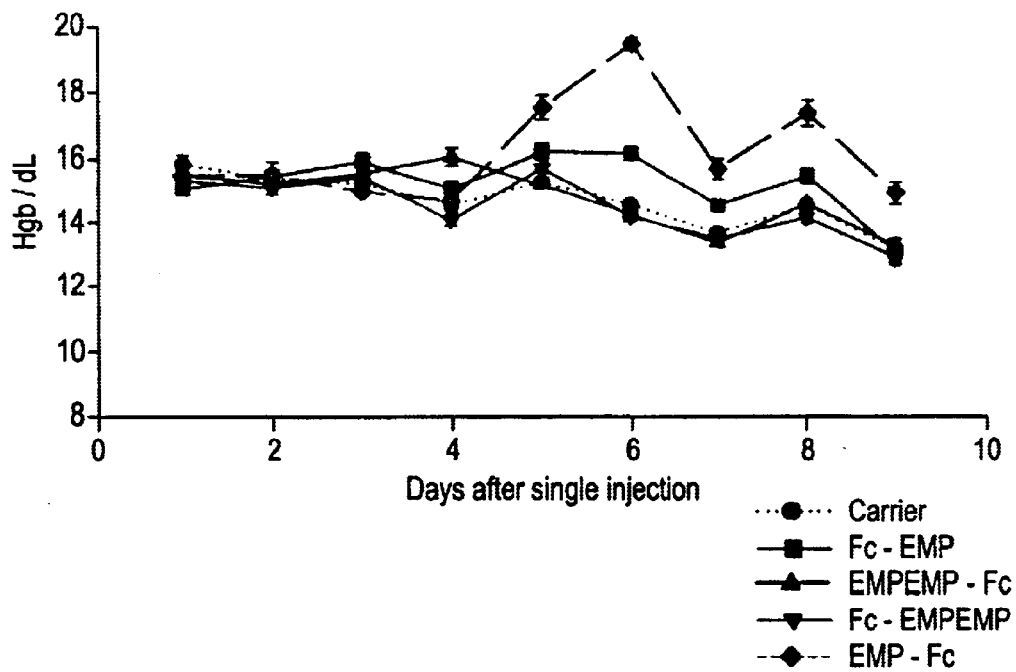
FIG. 1 shows a schematic representation of an exemplary process of the invention. In this preferred process, the vehicle is an Fc domain, which is linked to the peptide covalently by expression from a DNA construct encoding both the Fc domain and the peptide. As noted in FIG. 1, the Fc domains spontaneously form a dimer in this process.
Figures 2, 18A:
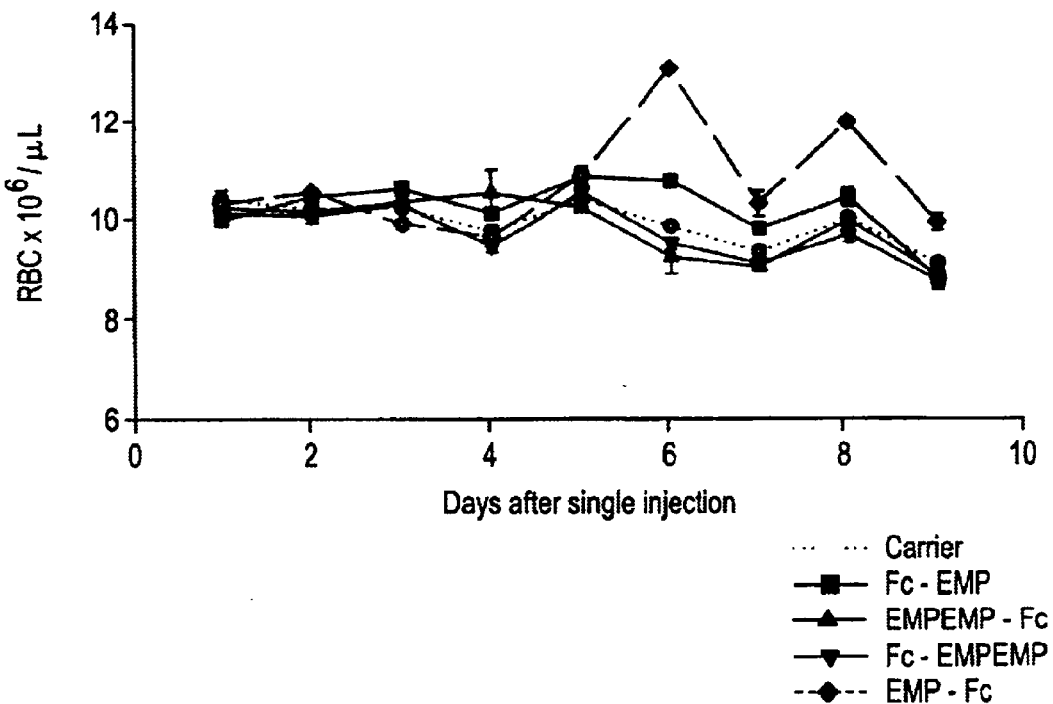
Figures 3, 18A:
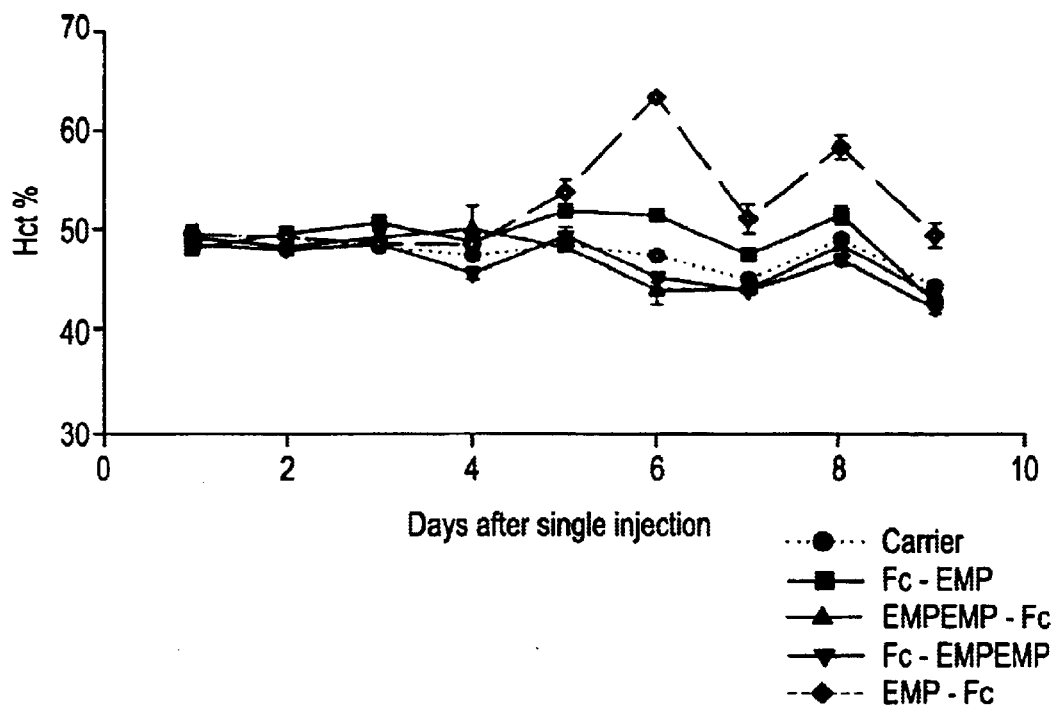
FIG. 3 shows the structure of preferred compounds of the invention that feature tandem repeats of the pharmacologically active peptide.

- PEG-MGDF: 20 kD average molecular weight PEG attached by reductive amination to the N-terminal amino group of amino acids 1–163 of native human TPO, which is expressed in *E. coli* (so that it is not glycosylated);
- TMP: the TPO-mimetic peptide having the amino acid sequence IEGPTLRQWLAARA (SEQ ID NO: 13);
- TMP-TMP: the TPO-mimetic peptide having the amino acid sequence IEGPTLRQWLAARA-GGGGGGG-IEGPTLRQWLAARA (SEQ ID NO: 14);
- PEG-TMP-TMP: the peptide of SEQ ID NO: 14, wherein the PEG group is a 5 kD average molecular weight PEG attached as shown in FIG. 6;
- Fc-TMP-TMP: the compound of SEQ ID NO: 8 (FIG. 8) dimerized with an identical second monomer (i.e., Cys residues 7 and 10 are bound to the corresponding Cys residues in the second monomer to form a dimer, as shown in FIG. 2); and
- TMP-TMP-Fc is the compound of SEQ ID NO: 10 (FIG. 9) dimerized in the same way as TMP-TMP-Fc except that the Fc domain is attached at the C-terminal end rather than the N-terminal end of the TMP-TMP peptide.

Figure 12:
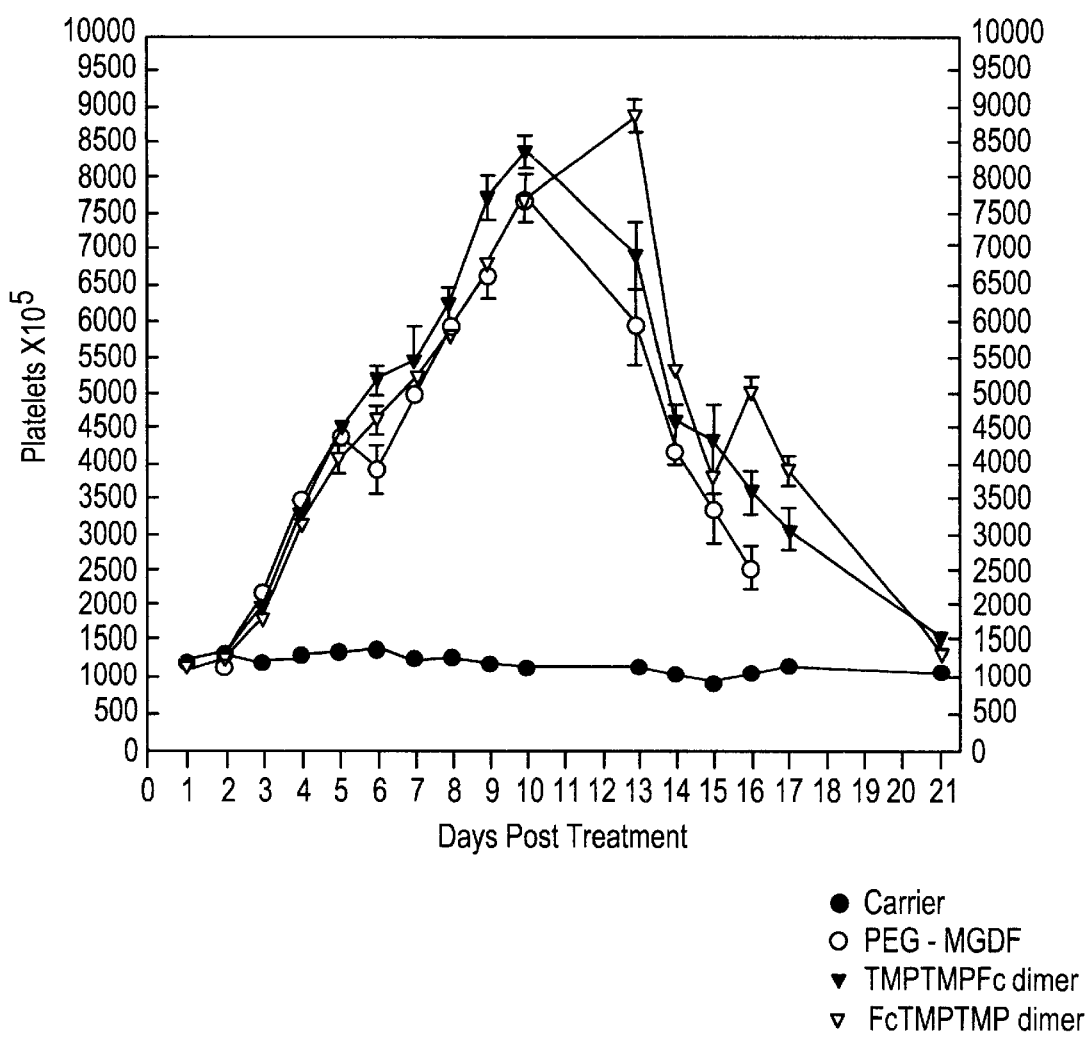

FIG. 12 shows the number of platelets generated in vivo in normal BDF1 mice treated with various compounds delivered via implanted osmotic pumps over a 7-day period. The compounds are as defined for FIG. 7.

FIG. 13 shows the nucleotide and amino acid sequences (SEQ. ID. NOS: 15 and 16, respectively) of the molecule identified as "Fc-EMP" in Example 3 hereinafter.

FIG. 14 shows the nucleotide and amino acid sequences (SEQ ID NOS: 17 and 18, respectively) of the molecule identified as "EMP-Fc" in Example 3 hereinafter.

FIG. 15 shows the nucleotide and amino acid sequences (SEQ ID NOS:19 and 20, respectively) of the molecule identified as "EMP-EMP-Fc" in Example 3 hereinafter.

FIG. 16 shows the nucleotide and amino acid sequences (SEQ ID NOS: 21 and 22, respectively) of the molecule identified as "Fc-EMP-EMP" in Example 3 hereinafter.

FIGS. 17A and 17B show the DNA sequence (SEQ ID NO: 23) inserted into pCFM1656 between the unique AatII (position #4364 in pCFM1656) and SacII (position #4585 in pCFM1656) restriction sites to form expression plasmid pAMG21 (ATCC accession no. 98113).

Figures 1, 18B:
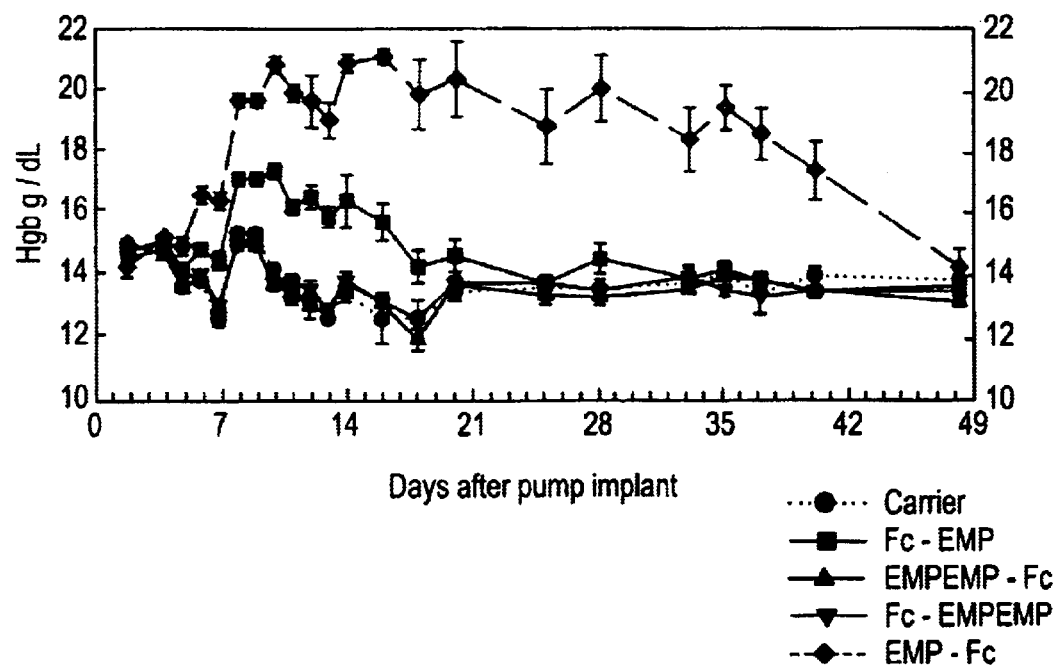
Figures 2, 18B:
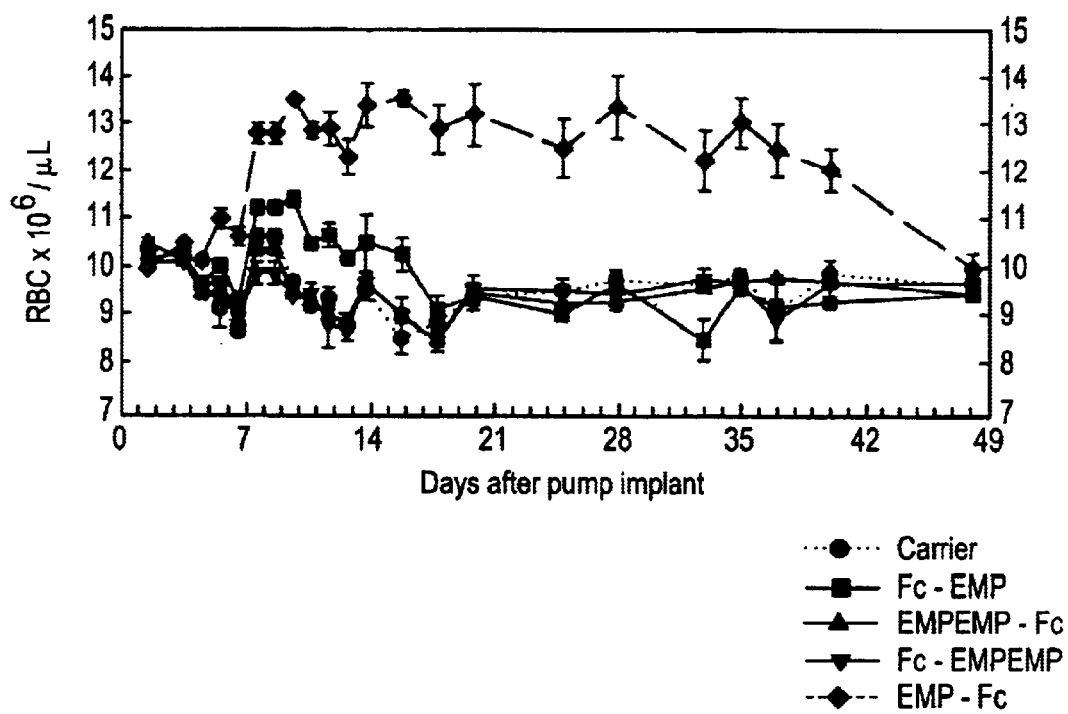
Figures 3, 18B:
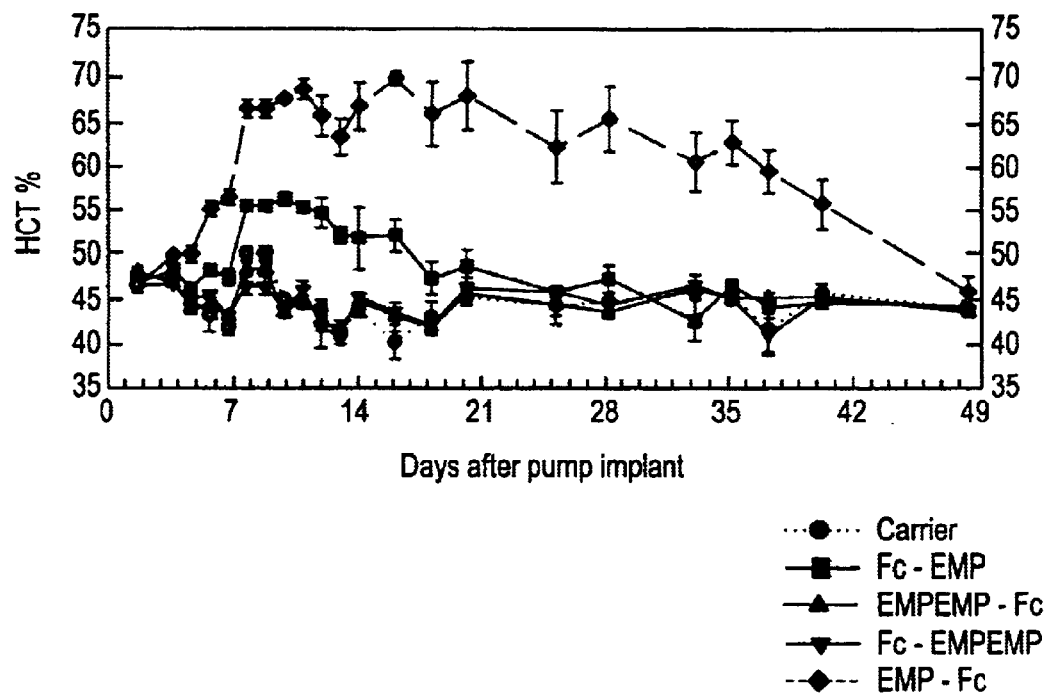

FIGS. 18A-1 to 18B-3 FIG. 18A shows the hemoglobin, red blood cells, and hematocrit generated in vivo in normal female BDF1 mice treated with one 100 µg/kg bolus injection of various compounds. FIG. 18B shows the same results with mice treated with 100 µg/kg per day delivered by 7-day micro-osmotic pump with the EMPs delivered at 100 µg/kg, rhEPO at 30 U/mouse. (In both experiments, neutrophils, lymphocytes, and platelets were unaffected.) In these figures, the terms are defined as follows.

Fc-EMP: the compound of SEQ ID NO: 16 (FIG. 13) dimerized with an identical second monomer (i.e., Cys residues 7 and 10 are bound to the corresponding Cys residues in the second monomer to form a dimer, as shown in FIG. 2);

EMP-Fc: the compound of SEQ ID NO: 18 (FIG. 14) dimerized in the same way as Fc-EMP except that the Fc domain is attached at the C-terminal end rather than the N-terminal end of the EMP peptide.

"EMP-EMP-Fc" refers to a tandem repeat of the same peptide (SEQ ID NO: 20) attached to the same Fc domain by the carboxyl terminus of the peptides. "Fc-EMP-EMP" refers to the same tandem repeat of the peptide but with the same Fc domain attached at the amino terminus of the tandem repeat. All molecules are expressed in *E. coli* and so are not glycosylated.

FIGS. 19A and 19B show the nucleotide and amino acid sequences (SEQ ID NOS: 1055 and 1056) of the Fc-TNF-α inhibitor fusion molecule described in Example 4 hereinafter.

FIGS. 20A and 20B show the nucleotide and amino acid sequences (SEQ ID NOS: 1057 and 1058) of the TNF-α inhibitor-Fc fusion molecule described in Example 4 hereinafter.

FIGS. 21A and 21B show the nucleotide and amino acid sequences (SEQ ID NOS: 1059 and 1060) of the Fc-IL-1 antagonist fusion molecule described in Example 5 hereinafter.

FIGS. 22A and 22B show the nucleotide and amino acid sequences (SEQ ID NOS: 1061 and 1062) of the IL-1 antagonist-Fc fusion molecule described in Example 5 hereinafter.

FIGS. 23A and 23B show the nucleotide and amino acid sequences (SEQ ID NOS: 1063 and 1064) of the Fc-VEGF antagonist fusion molecule described in Example 6 hereinafter.

FIGS. 24A and 24B show the nucleotide and amino acid sequences (SEQ ID NOS: 1065 and 1066) of the VEGF antagonist-Fc fusion molecule described in Example 6 hereinafter.

FIGS. 25A and 25B show the nucleotide and amino acid sequences (SEQ ID NOS: 1067 and 1068) of the Fc-MMP inhibitor fusion molecule described in Example 7 hereinafter.

FIGS. 26A and 26B show the nucleotide and amino acid sequences (SEQ ID NOS: 1069 and 1070) of the MMP inhibitor-Fc fusion molecule described in Example 7 hereinafter.

DETAILED DESCRIPTION OF THE INVENTION

Definition of Terms

The terms used throughout this specification are defined as follows, unless otherwise limited in specific instances.

The term "comprising" means that a compound may include additional amino acids on either or both of the N- or C-termini of the given sequence. Of course, these additional amino acids should not significantly interfere with the activity of the compound.

The term "vehicle" refers to a molecule that prevents degradation and/or increases half-life, reduces toxicity, reduces immunogenicity, or increases biological activity of a therapeutic protein. Exemplary vehicles include an Fc domain (which is preferred) as well as a linear polymer (e.g., polyethylene glycol (PEG), polylysine, dextran, etc.); a branched-chain polymer (see, for example, U.S. Pat. No. 4,289,872 to Denkenwalter et al., issued Sep. 15, 1981; U.S. Pat. No. 5,229,490 to Tam, issued Jul. 20, 1993; WO 93/21259 by Frechet et al., published Oct. 28, 1993); a lipid; a cholesterol group (such as a steroid); a carbohydrate or oligosaccharide; or any natural or synthetic protein, polypeptide or peptide that binds to a salvage receptor. Vehicles are further described hereinafter.

The term "native Fc" refers to molecule or sequence comprising the sequence of a non-antigen-binding fragment resulting from digestion of whole antibody, whether in monomeric or multimeric form. The original immunoglobulin source of the native Fc is preferably of human origin and may be any of the immunoglobulins, although IgG1 and IgG2 are preferred, Native Fc's are made up of monomeric polypeptides that may be linked into dimeric or multimeric forms by covalent (i.e., disulfide bonds) and non-covalent association. The number of intermolecular disulfide bonds between monomeric subunits of native Fc molecules ranges from 1 to 4 depending on class (e.g., IgG, IgA, IgE) or subclass (e.g., IgG1, IgG2, IgG3, IgA1, IgGA2). One example of a native Fc is a disulfide-bonded dimer resulting from papain digestion of an IgG (see Ellison et al. (1982), *Nucleic Acids Res.* 10: 4071–9). The term "native Fc" as used herein is generic to the monomeric, dimeric, and multimeric forms.

The term "Fc variant" refers to a molecule or sequence that is modified from a native Fc but still comprises a binding site for the salvage receptor, FcRn. International applications WO 97/34631 (published Sep. 25, 1997) and WO 96/32478 describe exemplary Fc variants, as well as interaction with the salvage receptor, and are hereby incorporated by reference. Thus, the term "Fc variant" comprises a molecule or sequence that is humanized from a non-human native Fc. Furthermore, a native Fc comprises sites that may be removed because they provide structural features or biological activity that are not required for the fusion molecules of the present invention. Thus, the term "Fc variant" comprises a molecule or sequence that lacks one or more native Fc sites or residues that affect or are involved in (1) disulfide bond formation, (2) incompatibility with a selected host cell (3) N-terminal heterogeneity upon expression in a selected host cell, (4) glycosylation, (5) interaction with complement, (6) binding to an Fc receptor other than a salvage receptor, or (7) antibody-dependent cellular cytotoxicity (ADCC). Fc variants are described in further detail hereinafter.

The term "Fc domain" encompasses native Fc and Fc variant molecules and sequences as defined above. As with Fc variants and native Fc's, the term "Fc domain" includes molecules in monomeric or multimeric form, whether digested from whole antibody or produced by other means.

The term "multimer" as applied to Fc domains or molecules comprising Fc domains refers to molecules having two or more polypeptide chains associated covalently, noncovalently, or by both covalent and non-covalent interactions. IgG molecules typically form dimers; IgM, pentamers; IgD, dimers; and IgA, monomers, dimers, trimers, or tetramers. Multimers may be formed by exploiting the sequence and resulting activity of the native Ig source of the Fc or by derivatizing (as defined below) such a native Fc.

The term "dimer" as applied to Fc domains or molecules comprising Fc domains refers to molecules having two polypeptide chains associated covalently or non-covalently. Thus, exemplary dimers within the scope of this invention are as shown in FIG. 2.

The terms "derivatizing" and "derivative" or "derivatized" comprise processes and resulting compounds respectively in which (1) the compound has a cyclic portion; for example, cross-linking between cysteinyl residues within the compound; (2) the compound is cross-linked or has a cross-linking site; for example, the compound has a cysteinyl residue and thus forms cross-linked dimers in culture or in vivo; (3) one or more peptidyl linkage is replaced by a non-peptidyl linkage; (4) the N-terminus is replaced by $—NRR^1$, $NRC(O)R^1$, $—NRC(O)OR^1$, $—NRS(O)_2R^1$, —NHC(O)NHR, a succinimide group, or substituted or unsubstituted benzyloxycarbonyl-NH—, wherein R and $R^1$ and the ring substituents are as defined hereinafter; (5) the C-terminus is replaced by $—C(O)R^2$ or $—NR^3R^4$ wherein $R^2$, $R^3$ and $R^4$ are as defined hereinafter; and (6) compounds in which individual amino acid moieties are modified through treatment with agents capable of reacting with selected side chains or terminal residues. Derivatives are further described hereinafter.

The term "peptide" refers to molecules of 2 to 40 amino acids, with molecules of 3 to 20 amino acids preferred and those of 6 to 15 amino acids most preferred. Exemplary peptides may be randomly generated by any of the methods cited above, carried in a peptide library (e.g., a phage display library), or derived by digestion of proteins.

The term "randomized" as used to refer to peptide sequences refers to fully random sequences (e.g., selected by phage display methods) and sequences in which one or more residues of a naturally occurring molecule is replaced by an amino acid residue not appearing in that position in the naturally occurring molecule. Exemplary methods for identifying peptide sequences include phage display, E. coli display, ribosome display, RNA-peptide screening, chemical screening, and the like.

The term "pharmacologically active" means that a substance so described is determined to have activity that affects a medical parameter (e.g., blood pressure, blood cell count, cholesterol level) or disease state (e.g., cancer, autoimmune disorders). Thus, pharmacologically active peptides comprise agonistic or mimetic and antagonistic peptides as defined below.

The terms "-mimetic peptide" and "-agonist peptide" refer to a peptide having biological activity comparable to a protein (e.g., EPO, TPO, G-CSF) that interacts with a protein of interest. These terms further include peptides that indirectly mimic the activity of a protein of interest, such as by potentiating the effects of the natural ligand of the protein of interest; see, for example, the G-CSF-mimetic peptides listed in Tables 2 and 7. Thus, the term "EPO-mimetic peptide" comprises any peptides that can be identified or derived as described in Wrighton et al. (1996), Science 273: 458–63, Naranda et al. (1999), Proc. Natl. Acad. Sci. USA 96: 7569–74, or any other reference in Table 2 identified as having EPO-mimetic subject matter. Those of ordinary skill in the art appreciate that each of these references enables one to select different peptides than actually disclosed therein by following the disclosed procedures with different peptide libraries.

The term "TPO-mimetic peptide" comprises peptides that can be identified or derived as described in Cwirla et al. (1997), Science 276: 1696–9, U.S. Pat. Nos. 5,869,451 and 5,932,946 and any other reference in Table 2 identified as having TPO-mimetic subject matter, as well as the U.S. patent application, "Thrombopoietic Compounds," filed on even date herewith and hereby incorporated by reference. Those of ordinary skill in the art appreciate that each of these references enables one to select different peptides than actually disclosed therein by following the disclosed procedures with different peptide libraries.

The term "G-CSF-mimetic peptide" comprises any peptides that can be identified or described in Paukovits et al. (1984), Hoppe-Seylers Z. Physiol. Chem. 365: 303–11 or any of the references in Table 2 identified as having G-CSF-mimetic subject matter. Those of ordinary skill in the art appreciate that each of these references enables one to select different peptides than actually disclosed therein by following the disclosed procedures with different peptide libraries.

The term "CTLA4-mimetic peptide" comprises any peptides that can be identified or derived as described in Fukumoto et al. (1998), Nature Biotech. 16: 267–70. Those of ordinary skill in the art appreciate that each of these references enables one to select different peptides than actually disclosed therein by following the disclosed procedures with different peptide libraries.

The term "-antagonist peptide" or "inhibitor peptide" refers to a peptide that blocks or in some way interferes with the biological activity of the associated protein of interest, or has biological activity comparable to a known antagonist or inhibitor of the associated protein of interest. Thus, the term "TNF-antagonist peptide" comprises peptides that can be identified or derived as described in Takasaki et al. (1997), Nature Biotech. 15: 1266–70 or any of the references in Table 2 identified as having TNF-antagonistic subject matter. Those of ordinary skill in the art appreciate that each of these references enables one to select different peptides than actually disclosed therein by following the disclosed procedures with different peptide libraries.

The terms "IL-1 antagonist" and "IL-1ra-mimetic peptide" comprises peptides that inhibit or down-regulate activation of the IL-1 receptor by IL-1. IL-1 receptor activation results from formation of a complex among IL-1, IL-1 receptor, and IL-1 receptor accessory protein. IL-1 antagonist or IL-1ra-mimetic peptides bind to IL-1, IL-1 receptor, or IL-1 receptor accessory protein and obstruct complex formation among any two or three components of the complex. Exemplary IL-1 antagonist or IL-1ra-mimetic peptides can be identified or derived as described in U.S. Pat. Nos. 5,608,035, 5,786,331, 5,880,096, or any of the references in Table 2 identified as having IL-1ra-mimetic or IL-1 antagonistic subject matter. Those of ordinary skill in the art appreciate that each of these references enables one to select different peptides than actually disclosed therein by following the disclosed procedures with different peptide libraries.

The term "VEGF-antagonist peptide" comprises peptides that can be identified or derived as described in Fairbrother (1998), Biochem. 37: 17754–64, and in any of the references in Table 2 identified as having VEGF-antagonistic subject matter. Those of ordinary skill in the art appreciate that each of these references enables one to select different peptides than actually disclosed therein by following the disclosed procedures with different peptide libraries.

The term "MMP inhibitor peptide" comprises peptides that can be identified or derived as described in Koivunen (1999), *Nature Biotech.* 17: 768–74 and in any of the references in Table 2 identified as having MMP inhibitory subject matter. Those of ordinary skill in the art appreciate that each of these references enables one to select different peptides than actually disclosed therein by following the disclosed procedures with different peptide libraries.

Additionally, physiologically acceptable salts of the compounds of this invention are also encompassed herein. By "physiologically acceptable salts" is meant any salts that are known or later discovered to be pharmaceutically acceptable. Some specific examples are: acetate; trifluoroacetate; hydrohalides, such as hydrochloride and hydrobromide; sulfate; citrate; tartrate; glycolate; and oxalate.

Structure of Compounds

In General. In the compositions of matter prepared in accordance with this invention, the peptide may be attached to the vehicle through the peptide's N-terminus or C-terminus. Thus, the vehicle-peptide molecules of this invention may be described by the following formula I:

$$(X^1)_a\text{-}F^1\text{-}(X^2)_b \qquad\qquad\qquad \text{I}$$

wherein:

$F^1$ is a vehicle (preferably an Fc domain);

$X^1$ and $X^2$ are each independently selected from $-(L^1)_c$-$P^1$, $-(L^1)_c$-$P^1$-$(L^2)_d$-$P^2$, $-(L^1)_c$-$P^1$-$(L^2)_d$-$P^2$-$(L^3)_e$-$P^3$, and $-(L^1)_c$-$P^1$-$(L^2)_d$-$P^2$-$(L^3)_e$-$P^3$-$(L^4)_f$-$P^4$ $P^1$, $P^2$, $P^3$, and $P^4$ are each independently sequences of pharmacologically active peptides;

$L^1$, $L^2$, $L^3$, and $L^4$ are each independently linkers; and a, b, c, d, e, and f are each independently 0 or 1, provided that at least one of a and b is 1.

Thus, compound I comprises preferred compounds of the formulae $$X^1\text{-}F^1 \qquad\qquad\qquad \text{II}$$

and multimers thereof wherein $F^1$ is an Fc domain and is attached at the C-terminus of $X^1$;

$$F^1\text{-}X^2 \qquad\qquad\qquad \text{III}$$

and multimers thereof wherein $F^1$ is an Fc domain and is attached at the N-terminus of $X^2$;

$$F^1\text{-}(L^1)_c\text{-}P^1 \qquad\qquad\qquad \text{IV}$$

and multimers thereof wherein $F^1$ is an Fc domain and is attached at the N-terminus of $-(L^1)_c$-$P^1$; and $$F^1\text{-}(L^1)_c\text{-}P^1\text{-}(L^2)_d\text{-}P^2 \qquad\qquad\qquad \text{V}$$

and multimers thereof wherein $F^1$ is an Fc domain and is attached at the N-terminus of $-L^1$-$P^1$-$L^2$-$P^2$.

Peptides. Any number of peptides may be used in conjunction with the present invention. Of particular interest are peptides that mimic the activity of EPO, TPO, growth hormone, G-CSF, GM-CSF, IL-1ra, leptin, CTLA4, TRAIL, TGF-α, and TGF-β. Peptide antagonists are also of interest, particularly those antagonistic to the activity of TNF, leptin, any of the interleukins (IL-1, 2, 3, . . . ), and proteins involved in complement activation (e.g., C3b). Targeting peptides are also of interest, including tumor-homing peptides, membrane-transporting peptides, and the like. All of these classes of peptides may be discovered by methods described in the references cited in this specification and other references.

Phage display, in particular, is useful in generating peptides for use in the present invention. It has been stated that affinity selection from libraries of random peptides can be used to identify peptide ligands for any site of any gene product. Dedman et al. (1993), *J. Biol. Chem.* 268: 23025–30. Phage display is particularly well suited for identifying peptides that bind to such proteins of interest as cell surface receptors or any proteins having linear epitopes. Wilson et al. (1998), *Can. J. Microbiol.* 44: 313–29; Kay et al. (1998), *Drug Disc. Today* 3: 370–8. Such proteins are extensively reviewed in Herz et al. (1997), *J. Receptor & Signal Transduction Res.* 17(5): 671–776, which is hereby incorporated by reference. Such proteins of interest are preferred for use in this invention.

A particularly preferred group of peptides are those that bind to cytokine receptors. Cytokines have recently been classified according to their receptor code. See Inglot (1997), *Archivum Immunologiae et Therapiae Experimentalis* 45: 353–7, which is hereby incorporated by reference. Among these receptors, most preferred are the CKRs (family I in Table 3). The receptor classification appears in Table 3.

TABLE 3

Cytokine Receptors Classified by Receptor Code

| | Cytokines (ligands) | | | Receptor Type | |
|---|---|---|---|---|---|
| | family | | subfamily | family | subfamily |
| I. | Hematopoietic cytokines | 1. | IL-2, IL-4, IL-7, IL-9, IL-13, IL-15 | I. Cytokine R (CKR) | 1. shared γCr |
| | | 2. | IL-3, IL-5, GM-CSF | | 2. shared GP 140 βR |
| | | 3. | IL-6, IL-11, IL-12, LIF, OSM, CNTF, leptin (OB) | | 3. shared RP 130 |
| | | 4. | G-CSF, EPO, TPO, PRL, GH | | 4. "single chain" R |
| | | 5. | IL-17, HVS-IL-17 | | 5. other R$^c$ |
| II. | IL-10 ligands | | IL-10, BCRF-1, HSV-IL-10 | II. IL-10 R | |

TABLE 3-continued

Cytokine Receptors Classified by Receptor Code

| | Cytokines (ligands) | | | Receptor Type | | |
|---|---|---|---|---|---|---|
| | family | subfamily | | family | | subfamily |
| III. | Interferons | 1. IFN-α1, α2, α4, m, t, IFN-β[d] | III. | Interferon R | 1. | IFNAR |
| | | 2. IFN-γ | | | 2. | IFNGR |
| IV. | IL-1 ligands | 1. IL-1α, IL-1β, IL-1Ra | IV. | IL-1R | | |
| V. | TNF ligands | 1. TNF-α, TNF-β (LT), FAS1, CD40 L, CD30L, CD27 L | V. | NGF/TNF R[e] | | |
| VI. | Chemokines | 1. α chemokines: IL-8, GRO α, β, γ, IF-10, PF-4, SDF-1 | VI. | Chemokine R | 1. | CXCR |
| | | 2. β chemokines: MIP1α, MIP1β, MCP-1,2,3,4, RANTES, eotaxin | | | 2. | CCR |
| | | 3. γ chemokines: lymphotactin | | | 3. | CR |
| | | | | | 4. | DARC[f] |
| VII. | Growth factors | | VII. | RKF | 1. | TK sub-family |
| | | 1.1 SCF, M-CSF, PDGF-AA, AB, BB, FLT-3L, VEGF, SSV-PDGF | | | 1.1 | IgTK III R |
| | | 1.2 FGFα, FGFβ | | | 1.2 | IgTK IV R |
| | | 1.3 EGF, TGF-α VV-F19 (EGF-like) | | | 1.3 | Cysteine-rich TK-I |
| | | 1.4 IGF-I, IGF-II, Insulin | | | 1.4 | Cysteine rich TK-II |
| | | 1.5 NGF, BDNF, NT-3, NT-4[g] | | | 1.5 | Cysteine knot TK V |
| | | 2. TGF-β1,β2,β3 | | | 2. | STK subfamily[h] |

[c]IL-17R belongs to the CKR family but is not assigned to any of the 4 indicated subfamilies.
[d]Other IFN type I subtypes remain unassigned. Hematopoietic cytokines, IL-10 ligands and interferons do not possess functional intrinsic protein kinases. The signaling molecules for the cytokines are JAK's, STATs and related non-receptor molecules. IL-14, IL-16 and IL-18 have been cloned but according to the receptor code they remain unassigned.
[e]TNF receptors use multiple, distinct intracellular molecules for signal transduction including "death domain" of FAS R and 55 kDa TNF-αR that participates in their cytotoxic effects. NGF/TNF R can bind both NGF and related factors as well as TNF ligands. Chemokine receptors are G protein-coupled, seven transmembrane (7TM, serpentine) domain receptors.
[f]The Duffy blood group antigen (DARC) is an erythrocyte receptor that can bind several different chemokines. It belongs to the immunoglobulin superfamily but characteristics of its signal transduction events remain unclear.
[g]The neurotrophic cytokines can associate with NGF/TNF receptors also.
[h]STKS may encompass many other TGF-β-related factors that remain unassigned. The protein kinases are intrinsic part of the intracellular domain of receptor kinase family (RKF). The enzymes participate in the signals transmission via the receptors.

Exemplary peptides for this invention appear in Tables 4 through 20 below. These peptides may be prepared by methods disclosed in the art. Single letter amino acid abbreviations are used. The X in these sequences (and throughout this specification, unless specified otherwise in a particular instance) means that any of the 20 naturally occurring amino acid residues may be present. Any of these peptides may be linked in tandem (i.e., sequentially), with or without linkers, and a few tandem-linked examples are provided in the table. Linkers are listed as "Λ" and may be any of the linkers described herein. Tandem repeats and linkers are shown separated by dashes for clarity. Any peptide containing a cysteinyl residue may be cross-linked with another Cys-containing peptide, either or both of which may be linked to a vehicle. A few cross-linked examples are provided in the table. Any peptide having more than one Cys residue may form an intrapeptide disulfide bond, as well; see, for example, EPO-mimetic peptides in Table 5. A few examples of intrapeptide disulfide-bonded peptides are specified in the table. Any of these peptides may be derivatized as described herein, and a few derivatized examples are provided in the table. Derivatized peptides in the tables are exemplary rather than limiting, as the associated underivatized peptides may be employed in this invention, as well. For derivatives in which the carboxyl terminus may be capped with an amino group, the capping amino group is shown as —$NH_2$. For derivatives in which amino acid residues are substituted by moieties other than amino acid residues, the substitutions are denoted by σ, which signifies any of the moieties described in Bhatnagar et al. (1996), *J. Med. Chem.* 39: 3814–9 and Cuthbertson et al. (1997), *J. Med. Chem.* 40: 2876–82, which are incorporated by reference. The J substituent and the Z substituents ($Z_5, Z_6, \ldots Z_{40}$) are as defined in U.S. Pat. Nos. 5,608,035, 5,786,331, and 5,880,096, which are incorporated by reference. For the EPO-mimetic sequences (Table 5), the substituents $X_2$ through $X_{11}$ and the integer "n" are as defined in WO 96/40772, which is incorporated by reference. The substituents "Ψ," "Θ" and "+" are as defined in Sparks et al. (1996), Proc. Natl. Acad. Sci. 93: 1540–4, which is hereby incorporated by reference. $X_4$, $X_5$, $X_6$, and $X_7$ are as defined in U.S. Pat. No. 5,773,569, which is hereby incorporated by reference, except that: for integrin-binding peptides, $X_1$, $X_2$, $X_3$, $X_4$, $X_5$, $X_6$, $X_7$, and $X_8$ are as defined in International applications WO 95/14714, published Jun. 1, 1995 and WO 97/08203, published Mar. 6, 1997, which are also incorporated by reference; and for VIP-mimetic peptides, $X_1$, $X_1'$, $X_1''$, $X_2$, $X_3$, $X_4$, $X_5$, $X_6$ and Z and the integers m and n are as defined in WO 97/40070, published Oct. 30, 1997, which is also incorporated by reference. Xaa and Yaa below are as defined in WO 98/09985, published Mar. 12, 1998, which is incorporated by reference. $AA_1$, $AA_2$, $AB_1$, $AB_2$, and AC are as defined in International application WO 98/53842, published Dec. 3, 1998, which is incorporated by reference. $X^1$, $X^2$, $X^3$, and $X^4$ in Table 17 only are as defined in European application EP 0 911 393, published Apr. 28, 1999. Residues appearing in boldface are D-amino acids. All peptides are linked through peptide bonds unless otherwise noted. Abbreviations are listed at the end of this specification. In the "SEQ ID NO." column, "NR" means that no sequence listing is required for the given sequence.

TABLE 4

IL-1 antagonist peptide sequences

| Sequence/structure | SEQ ID NO: |
|---|---|
| $Z_{11}Z_7Z_8QZ_5YZ_6Z_9Z_{10}$ | 212 |
| XXQZ$_5$YZ$_6$XX | 907 |
| Z$_7$XQZ$_5$YZ$_6$XX | 908 |
| Z$_7$Z$_8$QZ$_5$YZ$_6$Z$_9$Z$_{10}$ | 909 |
| Z$_{11}$Z$_7$Z$_8$QZ$_5$YZ$_6$Z$_9$Z$_{10}$ | 910 |
| Z$_{12}$Z$_{13}$Z$_{14}$Z$_{15}$Z$_{16}$Z$_{17}$Z$_{18}$Z$_{19}$Z$_{20}$Z$_{21}$Z$_{22}$Z$_{11}$Z$_7$Z$_8$QZ$_5$YZ$_6$Z$_9$Z$_{10}$L | 917 |
| Z$_{23}$NZ$_{24}$Z$_{39}$Z$_{25}$Z$_{26}$Z$_{27}$Z$_{28}$Z$_{29}$Z$_{30}$Z$_{40}$ | 979 |
| TANVSSFEWTPYYWQPYALPL | 213 |
| SWTDYGYWQPYALPISGL | 214 |
| ETPFTWEESNAYYWQPYALPL | 215 |
| ENTYSPNWADSMYWQPYALPL | 216 |
| SVGEDHNFWTSEYWQPYALPL | 217 |
| DGYDRWRQSGERYWQPYALPL | 218 |
| FEWTPGYWQPY | 219 |
| FEWTPGYWQHY | 220 |
| FEWTPGWYQJY | 221 |
| AcFEWTPGWYQJY | 222 |
| FEWTPGWpYQJY | 223 |
| FAWTPGYWQJY | 224 |
| FEWAPGYWQJY | 225 |
| FEWVPGYWQJY | 226 |
| FEWTPGYWQJY | 227 |
| AcFEWTPGYWQJY | 228 |
| FEWTPaWYQJY | 229 |
| FEWTPSarWYQJY | 230 |
| FEWTPGYYQPY | 231 |
| FEWTPGWWQPY | 232 |
| FEWTPNYWQPY | 233 |
| FEWTPvYWQJY | 234 |
| FEWTPecGYWQJY | 235 |
| FEWTPAibYWQJY | 236 |
| FEWTSarGYWQJY | 237 |
| FEWTPGYWQPY | 238 |
| FEWTPGYWQHY | 239 |
| FEWTPGWYQJY | 240 |
| AcFEWTPGWYQJY | 241 |
| FEWTPGW-pY-QJY | 242 |
| FAWTPGYWQJY | 243 |
| FEWAPGYWQJY | 244 |
| FEWVPGYWQJY | 245 |

TABLE 4-continued

IL-1 antagonist peptide sequences

| Sequence/structure | SEQ ID NO: |
|---|---|
| FEWTPGYWQJY | 246 |
| AcFEWTPGYWQJY | 247 |
| FEWTPAWYQJY | 248 |
| FEWTPSarWYQJY | 249 |
| FEWTPGYYQPY | 250 |
| FEWTPGWWQPY | 251 |
| FEWTPNYWQPY | 252 |
| FEWTPVYWQJY | 253 |
| FEWTPecGYWQJY | 254 |
| FEWTPAibYWQJY | 255 |
| FEWTSarGYWQJY | 256 |
| FEWTPGYWQPYALPL | 257 |
| 1NapEWTPGYYQJY | 258 |
| YEWTPGYYQJY | 259 |
| FEWVPGYYQJY | 260 |
| FEWTPSYYQJY | 261 |
| FEWTPNYYQJY | 262 |
| TKPR | 263 |
| RKSSK | 264 |
| RKQDK | 265 |
| NRKQDK | 266 |
| RKQDKR | 267 |
| ENRKQDKRF | 268 |
| VTKFYF | 269 |
| VTKFY | 270 |
| VTDFY | 271 |
| SHLYWQPYSVQ | 671 |
| TLVYWQPYSLQT | 672 |
| RGDYWQPYSVOS | 673 |
| VHVYWQPYSVQT | 674 |
| RLVYWQPYSVQT | 675 |
| SRVWFQPYSLQS | 676 |
| NMVYWQPYSIQT | 677 |
| SVVFWQPYSVQT | 678 |
| TFVYWQPYALPL | 679 |
| TLVYWQPYSIQR | 680 |
| RLVYWQPYSVQR | 681 |
| SPVFWQPYSIQI | 682 |
| WIEWWQPYSVQS | 683 |
| SLIYWQPYSLQM | 684 |
| TRLYWQPYSVQR | 685 |
| RCDYWQPYSVQT | 686 |
| MRVFWQPYSVQN | 687 |
| KIVYWQPYSVQT | 688 |
| RHLYWQPYSVQR | 689 |
| ALVWWQPYSEQI | 690 |
| SRVWFQPYSLQS | 691 |
| WEQPYALPLE | 692 |
| QLVWWQPYSVQR | 693 |
| DLRYWQPYSVQV | 694 |
| ELVWWQPYSLQL | 695 |
| DLVWWQPYSVQW | 696 |
| NGNYWQPYSFQV | 697 |
| ELVYWQPYSIQR | 698 |
| ELMYWQPYSVQE | 699 |
| NLLYWQPYSMQD | 700 |
| GYEWYQPYSVQR | 701 |
| SRVWYQPYSVQR | 702 |
| LSEQYQPYSVQR | 703 |
| GGGWWQPYSVQR | 704 |
| VGRWYQPYSVQR | 705 |
| VHVYWQPYSVQR | 706 |
| QARWYQPYSVQR | 707 |
| VHVYWQPYSVQT | 708 |
| RSVYWQPYSVQR | 709 |
| TRVWFQPYSVQR | 710 |
| GRIWFQPYSVQR | 711 |
| GRVWFQPYSVQR | 712 |
| ARTWYQPYSVQR | 713 |
| ARVWWQPYSVQM | 714 |
| RLMFYQPYSVQR | 715 |
| ESMWYQPYSVQR | 716 |
| HFGWWQPYSVHM | 717 |
| ARFWWQPYSVQR | 718 |

TABLE 4-continued

IL-1 antagonist peptide sequences

| Sequence/structure | SEQ ID NO: |
|---|---|
| RLVYWQ PYAPIY | 719 |
| RLVYWQ PYSYQT | 720 |
| RLVYWQ PYSLPI | 721 |
| RLVYWQ PYSVQA | 722 |
| SRVWYQ PYAKGL | 723 |
| SRVWYQ PYAQGL | 724 |
| SRVWYQ PYAMPL | 725 |
| SRVWYQ PYSVQA | 726 |
| SRVWYQ PYSLGL | 727 |
| SRVWYQ PYAREL | 728 |
| SRVWYQ PYSRQP | 729 |
| SRVWYQ PYFVQP | 730 |
| EYEWYQ PYALPL | 731 |
| IPEYWQ PYALPL | 732 |
| SRIWWQ PYALPL | 733 |
| DPLFWQ PYALPL | 734 |
| SRQWVQ PYALPL | 735 |
| IRSWWQ PYALPL | 736 |
| RGYWQ PYALPL | 737 |
| RLLWVQ PYALPL | 738 |
| EYRWFQ PYALPL | 739 |
| DAYWVQ PYALPL | 740 |
| WSGYFQ PYALPL | 741 |
| NIEFWQ PYALPL | 742 |
| TRDWVQ PYALPL | 743 |
| DSSWYQ PYALPL | 744 |
| IGNWYQ PYALPL | 745 |
| NLRWDQ PYALPL | 746 |
| LPEFWQ PYALPL | 747 |
| DSYWWQ PYALPL | 748 |
| RSQYYQ PYALPL | 749 |
| ARFWLQ PYALPL | 750 |
| NSYFWQ PYALPL | 751 |
| RFMYWQPYSVQR | 752 |
| AHLFWQPYSVQR | 753 |
| WWQPYALPL | 754 |
| YYQPYALPL | 755 |
| YFQPYALGL | 756 |
| YWYQPYALPL | 757 |
| RWWQPYATPL | 758 |
| GWYQPYALGF | 759 |
| YWYQPYALGL | 760 |
| IWYQPYAMPL | 761 |
| SNMQPYQRLS | 762 |
| TFVYWQPY AVGLPAAETACN | 763 |
| TFVYWQPY SVQMTITGKVTM | 764 |
| TFVYWQPY SSHXXVPXGFPL | 765 |
| TFVYWQPY YGNPQWAIHVRH | 766 |
| TFVYWQPY VLLELPEGAVRA | 767 |
| TFVYWQPY VDYVWPIPIAQV | 768 |
| GWYQPYVDGWR | 769 |
| RWEQPYVKDGWS | 770 |
| EWYQPYALGWAR | 771 |
| GWWQPYARGL | 772 |
| LFEQPYAKALGL | 773 |
| GWEQPYARGLAG | 774 |
| AWVQPYATPLDE | 775 |
| MWYQPYSSQPAE | 776 |
| GWTQPYSQQGEV | 777 |
| DWFQPYSIQSDE | 778 |
| PWIQPYARGFG | 779 |
| RPLYWQPYSVQV | 780 |
| TLIYWQPYSVQI | 781 |
| RFDYWQPYSDQT | 782 |
| WHQFVQPYALPL | 783 |
| EWDS VYWQPYSVQ TLLR | 784 |
| WEQN VYWQPYSVQ SFAD | 785 |
| SDV VYWQPYSVQ SLEM | 786 |
| YYDG VYWQPYSVQ VMPA | 787 |
| SDIWYQ PYALPL | 788 |
| QRIWWQ PYALPL | 789 |
| SRIWWQ PYALPL | 790 |
| RSLYWQ PYALPL | 791 |
| TIIWEQ PYALPL | 792 |
| WETWYQ PYALPL | 793 |
| SYDWEQ PYALPL | 794 |
| SRIWCQ PYALPL | 795 |
| EIMFWQ PYALPL | 796 |
| DYVWQQ PYALPL | 797 |
| MDLLVQ WYQPYALPL | 798 |
| GSKVIL WYQPYALPL | 799 |
| RQGANI WYQPYALPL | 800 |
| GGGDEP WYQPYALPL | 801 |
| SQLERT WYQPYALPL | 802 |
| ETWVRE WYQPYALPL | 803 |
| KKGSTQ WYQPYALPL | 804 |
| LQARMN WYQPYALPL | 805 |
| EPRSQK WYQPYALPL | 806 |
| VKQKWR WYQPYALPL | 807 |
| LRRHDV WYQPYALPL | 808 |
| RSTASI WYQPYALPL | 809 |
| ESKEDQ WYQPYALPL | 810 |
| EGLTMK WYQPYALPL | 811 |
| EGSREG WYQPYALPL | 812 |
| VIEWWQ PYALPL | 813 |
| VWYWEQ PYALPL | 814 |
| ASEWWQ PYALPL | 815 |
| FYEWWQ PYALPL | 816 |
| EGWWVQ PYALPL | 817 |
| WGEWLQ PYALPL | 818 |
| DYVWEQ PYALPL | 819 |
| AHTWWQ PYALPL | 820 |
| FIEWFQ PYALPL | 821 |
| WLAWEQ PYALPL | 822 |
| VMEWWQ PYALPL | 823 |
| ERMWQ PYALPL | 824 |
| NXXWXX PYALPL | 825 |
| WGNWYQ PYALPL | 826 |
| TLYWEQ PYALPL | 827 |
| VWRWEQ PYALPL | 828 |
| LLWTQ PYALPL | 829 |
| SRIWXX PYALPL | 830 |
| SDIWYQ PYALPL | 831 |
| WGYYXX PYALPL | 832 |
| TSGWYQ PYALPL | 833 |
| VHPYXX PYALPL | 834 |
| EHSYFQ PYALPL | 835 |
| XXIWYQ PYALPL | 836 |
| AQLHSQ PYALPL | 837 |
| WANWFQ PYALPL | 838 |
| SRLYSQ PYALPL | 839 |
| GVTFSQ PYALPL | 840 |
| SIVWSQ PYALPL | 841 |
| SRDLVQ PYALPL | 842 |
| HWGH VYWQPYSVQ DDLG | 843 |
| SWHS VYWQPYSVQ SVPE | 844 |
| WRDS VYWQPYSVQ PESA | 845 |
| TWDA VYWQPYSVQ KWLD | 846 |
| TPPW VYWQPYSVQ SLDP | 847 |
| YWSS VYWQPYSVQ SVHS | 848 |
| YWY QPY ALGL | 849 |
| YWY QPY ALPL | 850 |
| EWI QPY ATGL | 851 |
| NWE QPY AKPL | 852 |
| AFY QPY ALPL | 853 |
| FLY QPY ALPL | 854 |
| VCK QPY LEWC | 855 |
| ETPFTWEESNAYYWQPYALPL | 856 |
| QGWLTWQDSVDMYWQPYALPL | 857 |
| FSEAGYTWPENTYWQPYALPL | 858 |
| TESPGGLDWAKIYWQPYALPL | 859 |
| DGYDRWRQSGERYWQPYALPL | 860 |
| TANVSSFEWTPGYWQPYALPL | 861 |
| SVGEDHNFWTSE YWQPYALPL | 862 |
| MNDQTSEVSTFP YWQPYALPL | 863 |
| SWSEAFEQPRNL YWQPYALPL | 864 |
| QYAEPSALNDWG YWQPYALPL | 865 |
| NGDWATADWSNY YWQPYALPL | 866 |

TABLE 4-continued

IL-1 antagonist peptide sequences

| Sequence/structure | SEQ ID NO: |
|---|---|
| THDEHI YWQPYALPL | 867 |
| MLEKTYTTWTPG YWQPYALPL | 868 |
| WSDPLTRDADL YWQPYALPL | 869 |
| SDAFUQDSQAM YWQPYALPL | 870 |
| GDDAAWRTDSLT YWQPYALPL | 871 |
| AIIRQLYRWSEM YWQPYALPL | 872 |
| ENTYSPNWADSM YWQPYALPL | 873 |
| MNDQTSEVSTFP YWQPYALPL | 874 |
| SVGEDHNFWTSE YWQPYALPL | 875 |
| QTPFTWEESNAY YWQPYALPL | 876 |
| ENPFTWQESNAY YWQPYALPL | 877 |
| VTPFTWEDSNVF YWQPYALPL | 878 |
| QIPFTWEQSNAY YWQPYALPL | 879 |
| QAPLTWQESAAY YWQPYALPL | 880 |
| EPTFTWEESKAT YWQPYALPL | 881 |
| TTTLTWEESNAY YWQPYALPL | 882 |
| ESPLTWEESSAL YWQPYALPL | 883 |
| ETPLTWEESNAY YWQPYALPL | 884 |
| EATFTWAESNAY YWQPYALPL | 885 |
| EALFTWKESTAY YWQPYALPL | 886 |
| STP-TWEESNAY YWQPYALPL | 887 |
| ETPFTWEESNAY YWQPYALPL | 888 |
| KAPFTWEESQAY YWQPYALPL | 889 |
| STSFTWEESNAY YWQPYALPL | 890 |
| DSTFTWEESNAY YWQPYALPL | 891 |
| YIPFTWEESNAY YWQPYALPL | 892 |
| QTAFTWEESNAY YWQPYALPL | 893 |
| ETLFTWEESNAT YWQPYALPL | 894 |
| VSSFTWEESNAY YWQPYALPL | 895 |
| QPYALPL | 896 |
| Py-1-NapPYQJYALPL | 897 |
| TANVSSFEWTPG YWQPYALPL | 898 |
| FEWTPGYWQPYALPL | 899 |
| FEWTPGYWQJYALPL | 900 |
| FEWTPGYYQJYALPL | 901 |
| ETPFTWEESNAYYWQPYALPL | 902 |
| FTWEESNAYYWQJYALPL | 903 |
| ADVL YWQPYA PVTLWV | 904 |
| GDVAE YWQPYA LPLTSL | 905 |
| SWTDYG YWQPYA LPISGL | 906 |
| FEWTPGYWQPYALPL | 911 |
| FEWTPGYWQJYALPL | 912 |
| FEWTPGWYQPYALPL | 913 |
| FEWTPGWYQJYALPL | 914 |
| FEWTPGYYQPYALPL | 915 |
| FEWTPGYYQJYALPL | 916 |
| TANVSSFEWTPGYWQPYALPL | 918 |
| SWTDYGYWQPYALPISGL | 919 |
| ETPFTWEESNAYYWQPYALPL | 920 |
| ENTYSPNWADSMYWQPYALPL | 921 |
| SVGEDHNFWTSEYWQPYALPL | 922 |
| DGYDRWRQSGERYWQPYALPL | 923 |
| FEWTPGYWQPYALPL | 924 |
| FEWTPGYWQPY | 925 |
| FEWTPGYWQJY | 926 |
| EWTPGYWQPY | 927 |
| FEWTPGWYQJY | 928 |
| AEWTPGYWQJY | 929 |
| FAWTPGYWQJY | 930 |
| FEATPGYWQJY | 931 |
| FEWAPGYWQJY | 932 |
| FEWTAGYWQJY | 933 |
| FEWTPAYWQJY | 934 |
| FEWTPGAWQJY | 935 |
| FEWTPGYAQJY | 936 |
| FEWTPGYWQJA | 937 |
| FEWTGGYWQJY | 938 |
| FEWTPGYWQJY | 939 |
| FEWTJGYWQJY | 940 |
| FEWTPecGYWQJY | 941 |
| FEWTPAibYWQJY | 942 |
| FEWTPSarWYQJY | 943 |
| FEWTSarGYWQJY | 944 |
| FEWTPNYWQJY | 945 |

TABLE 4-continued

IL-1 antagonist peptide sequences

| Sequence/structure | SEQ ID NO: |
|---|---|
| FEWTPVYWQJY | 946 |
| FEWTVPYWQJY | 947 |
| AcFEWTPGWYQJY | 948 |
| AcFEWTPGYWQJY | 949 |
| INap-EWTPGYYQJY | 950 |
| YEWTPGYYQJY | 951 |
| FEWVPGYYQJY | 952 |
| FEWTPGYYQJY | 953 |
| FEWTPsYYQJY | 954 |
| FEWTPnYYQJY | 955 |
| SHLY-Nap-QPYSVQM | 956 |
| TLVY-Nap-QPYSLQT | 957 |
| RGDY-Nap-QPYSVQS | 958 |
| NMVY-Nap-QPYSIQT | 959 |
| VYWQPYSVQ | 960 |
| VY-Nap-QPYSVQ | 961 |
| TFVYWQJYALPL | 962 |
| FEWTPGYYQJ-Bpa | 963 |
| XaaFEWTPGYYQJ-Bpa | 964 |
| FEWTPGY-Bpa-QJY | 965 |
| AcFEWTPGY-Bpa-QJY | 966 |
| FEWTPG-Bpa-YQJY | 967 |
| AcFEWTPG-Bpa-YQJY | 968 |
| AcFE-Bpa-TPGYYQJY | 969 |
| AcFE-Bpa-TPGYYQJY | 970 |
| Bpa-EWTPGYYQJY | 971 |
| AcBpa-EWTPGYYQJY | 972 |
| VYWQPYSVQ | 973 |
| RLVYWQPYSVQR | 974 |
| RLVY-Nap-QPYSVQR | 975 |
| RLDYWQPYSVQR | 976 |
| RLVWFQPYSVQR | 977 |
| RLVYWQPYSIQR | 978 |
| DNSSWYDSFLL | 980 |
| DNTAWYESFLA | 981 |
| DNTAWYENFLL | 982 |
| PARE DNTAWYDSFLI WC | 983 |
| TSEY DNTTWYEKFLA SQ | 984 |
| SQIP DNTAWYQSFLL HG | 985 |
| SPFI DNTAWYENFLL TY | 986 |
| EQIY DNTAWYDHFLL SY | 987 |
| TPFI DNTAWYENFLL TY | 988 |
| TYTY DNTAWYERFLM SY | 989 |
| TMTQ DNTAWYENFLL SY | 990 |
| TI DNTAWYANLVQ TYPQ | 991 |
| TI DNTAWYERFLA QYPD | 992 |
| HI DNTAWYENFLL TYTP | 993 |
| SQ DNTAWYENFLL SYKA | 994 |
| QI DNTAWYERFLL QYNA | 995 |
| NQ DNTAWYESFLL QYNT | 996 |
| TI DNTAWYENFLL NHNL | 997 |
| HY DNTAWYERFLQ QGWH | 998 |
| ETPFTWEESNAYYWQPYALPL | 999 |
| YIPFTWEESNAYYWQPYALPL | 1000 |
| DGYDRWRQSGERYWQPYALPL | 1001 |
| pY-INap-pY-QJYALPL | 1002 |
| TANVSSFEWTPGYWQPYALPL | 1003 |
| FEWTPGYWQJYALPL | 1004 |
| FEWTPGYWQPYALPLSD | 1005 |
| FEWTPGYYQJYALPL | 1006 |
| FEWTPGYWQJY | 1007 |
| AcFEWTPGYWQJY | 1008 |
| AcFEWTPGWYQJY | 1009 |
| AcFEWTPGYYQJY | 1010 |
| AcFEWTPaYWQJY | 1011 |
| AcFEWTPaWYQJY | 1012 |
| AcFEWTPaYYQJY | 1013 |
| FEWTPGYYQJYALPL | 1014 |
| FEWTPGYWQJYALPL | 1015 |
| FEWTPGWYQJYALPL | 1016 |
| TANVSSFEWTPGYWQPYALPL | 1017 |
| AcFEWTPGYWQJY | 1018 |
| AcFEWTPGWYQJY | 1019 |
| AcFEWTPGYYQJY | 1020 |

TABLE 4-continued

IL-1 antagonist peptide sequences

| Sequence/structure | SEQ ID NO: |
|---|---|
| AcFEWTPAYWQJY | 1020 |
| AcFEWTPAWYQJY | 1022 |
| AcFEWTPAYYQJY | 1023 |

TABLE 5

EPO-mimetic peptide sequences

| Sequence/structure | SEQ ID NO: |
|---|---|
| YXCXXGPXTWXCXP | 83 |
| YXCXXGPXTWXCXP-YXCXXGPXTWXCXP | 84 |
| YXCXXGPXTWXCXP-Λ-YXCXXGPXTWXCXP | 85 |
| YXCXXGPXTWXCXP-Λ- \ (ε-amine) / K / βA YXCXXGPXTWXCXP-Λ- (α-amine) | 86 |
| GGTYSCHFGPLTWVCKPQGG | 87 |
| GGDYHCRMGPLTWVCKPLGG | 88 |
| GGVYACRMGPITWVCSPLGG | 89 |
| VGNYMCHFGPITWVCRPGGG | 90 |
| GGLYLCRFGPVTWDCGYKGG | 91 |
| GGTYSCHFGPLTWVCKPQGG-GGTYSCHFGPLTWVCKPQGG | 92 |
| GGTYSCHFGPLTWVCKPQGG-Λ-GGTYSCHFGPLTWVCKPQGG | 93 |
| GGTYSCHFGPLTWVCKPQGGSSK | 94 |
| GGTYSCHFGPLTWVCKPQGGSSK-GGTYSCHFGPLTWVCKPQGGSSK | 95 |
| GGTYSCHFGPLTWVCKPQGGSSK-Λ-GGTYSCHFGPLTWVCKPQGGSSK | 96 |
| GGTYSCHFGPLTWVCKPQGGSS \ (ε-amine) / K / βA GGTYSCHFGPLTWVCKPQGGSS (α-amine) | 97 |
| GGTYSCHFGPLTWVCKPQGGSSK(-Λ-biotin) | 98 |
| $CX_4X_5GPX_6TWX_7C$ | 421 |
| GGTYSCHGPLTWVCKPQGG | 422 |
| VGNYMAHMGPITWVCRPGG | 423 |
| GGPHHVYACRMGPLTWIC | 424 |
| GGTYSCHFGPLTWVCKPQ | 425 |
| GGLYACHMGPMTWVCQPLRG | 426 |
| TIAQYICYMGPETWECRPSPKA | 427 |
| YSCHFGPLTWVCK | 428 |
| YCHFGPLTWVC | 429 |
| $X_3X_4X_5GPX_6TWX_7X_8$ | 124 |
| $YX_2X_3X_4X_5GPX_6TWX_7X_8$ | 461 |
| $X_1YX_2X_3X_4X_5GPX_6TWX_7X_8X_9X_{10}X_{11}$ | 419 |
| $X_1YX_2CX_4X_5GPX_6TWX_7CX_9X_{10}X_{11}$ | 420 |
| GGLYLCRFGPVTWDCGYKGG | 1024 |
| GGTYSCHFGPLTWVCKPQGG | 1025 |
| GGDYHCRMGPLTWVCKPLGG | 1026 |
| VGNYMCHFGPITWVCRPGGG | 1029 |
| GGVYACRMGPITWVCSPLGG | 1030 |
| VGNYMAHMGPITWVCRPGG | 1035 |
| GGTYSCHFGPLTWVCKPQ | 1036 |
| GGLYACHMGPMTWVCQPLRG | 1037 |
| TIAQYICYMGPETWECRPSPKA | 1038 |
| YSCHFGPLTWVCK | 1039 |
| YCHFGPLTWVC | 1040 |
| SCHFGPLTWVCK | 1041 |
| $(AX_2)_nX_3X_4X_5GPX_6TWX_7X_8$ | 1042 |

TABLE 6

TPO-mimetic peptide sequences

| Sequence/structure | SEQ ID NO: |
|---|---|
| IEGPTLRQWLAARA | 13 |
| IEGPTLRQWLAAKA | 24 |
| IEGPTLREWLAARA | 25 |
| IEGPTLRQWLAARA-Λ-IEGPTLRQWLAARA | 26 |
| IEGPTLRQWLAAKA-Λ-IEGPTLRQWLAAKA | 27 |
| IEGPTLRQCLAARA-Λ-IEGPTLRQCLAARA | 28 |
| IEGPTLRQWLAARA-Λ-K(BrAc)-Λ-IEGPTLRQWLAARA | 29 |
| IEGPTLRQWLAARA-Λ-K(PEG)-Λ-IEGPTLRQWLAARA | 30 |
| IEGPTLRQCLAARA-Λ-IEGPTLRQWLAARA | 31 |
| IEGPTLRQCLAARA-Λ-IEGPTLRQWLAARA | 31 |
| IEGPTLRQWLAARA-Λ-IEGPTLRQCLAARA | 32 |
| IEGPTLRQWLAARA-Λ-IEGPTLRQCLAARA | 32 |
| VRDQIXXXL | 33 |
| TLREWL | 34 |
| GRVRDQVAGW | 35 |
| GRVKDQIAQL | 36 |
| GVRDQVSWAL | 37 |
| ESVREQVMKY | 38 |
| SVRSQISASL | 39 |
| GVRETVYRHM | 40 |
| GVREVIVMHML | 41 |
| GRVRDQIWAAL | 42 |
| AGVRDQILIWL | 43 |
| GRVRDQIMLSL | 44 |
| $GRVRDQI(X)_3L$ | 45 |
| CTLRQWLQGC | 46 |
| CTLQEFLEGC | 47 |
| CTRTEWLHGC | 48 |
| CTLREWLHGGFC | 49 |
| CTLREWVFAGLC | 50 |
| CTLRQWLILLGMC | 51 |
| CTLAEFLASGVEQC | 52 |
| CSLQEFLSHGGYVC | 53 |
| CTLREFLDPTTAVC | 54 |
| CTLKEWLVSHEVWC | 55 |
| $CTLREWL(X)_{2-6}C$ | 56–60 |
| REGPTLRQWM | 61 |
| EGPTLRQWLA | 62 |
| ERGPFWAKAC | 63 |
| REGPRCVMWM | 64 |
| CGTEGPTLSTWLDC | 65 |
| CEQDGPTLLEWLKC | 66 |
| CELVGPSLMSWLTC | 67 |
| CLTG PFVTQWLYEC | 68 |
| CRAGPTLLEWLTLC | 69 |
| CADGPTLREWISFC | 70 |
| $C(X)_{1-2}EGPTLREWL(X)_{1-2}C$ | 71–74 |
| GGCTLREWLHGGFCGG | 75 |
| GGCADGPTLREWISFCGG | 76 |
| GNADGPTLRQWLEGRRPKN | 77 |
| LAIEGPTLROWLHGNGRDT | 78 |
| HGRVGPTLREWKTQVATKK | 79 |
| TIKGPTLROWLKSREHTS | 80 |
| ISDGPTLKEWLSVTRGAS | 81 |
| SIEGPTLREWLTSRTPHS | 82 |

TABLE 7

G-CSF-mimetic peptide sequences

| Sequence/structure | SEQ ID NO: |
|---|---|
| EEDCK | 99 |
| EEDCK | 99 |
| \| | |
| EEDCK | 99 |
| EEDoK | 100 |
| EEDoK | 100 |
| \| | |
| EEDoK | 100 |
| pGluEDoK | 101 |
| pGluEDoK | 101 |
| \| | |
| pGluEDoK | 101 |
| PicSDoK | 102 |
| PicSDoK | 102 |
| \| | |
| PicSDoK | 102 |
| EEDCK-Λ-EEDCK | 103 |
| EEDXK-Λ-EEDXK | 104 |

TABLE 8

TNF-antagonist peptide sequences

| Sequence/structure | SEQ ID NO: |
|---|---|
| YCFTASENHCY | 106 |
| YCFTNSENHCY | 107 |
| YCFTRSENHCY | 108 |
| FCASENHCY | 109 |
| YCASENHCY | 110 |
| FCNSENHCY | 111 |
| FCNSENRCY | 112 |
| YCSQSVSNDCF | 113 |
| FCVSNDRCY | 114 |
| YCRKELGQVCY | 115 |
| YCKEPGQCY | 116 |
| YCRKEMGCY | 117 |
| FCRKEMGCY | 118 |
| YCWSQNLCY | 119 |
| YCELSQYLCY | 120 |
| YCWSQNYCY | 121 |
| YCWSQYLCY | 122 |
| DFLPHYKNTSLGHRP | 123 |
| | 1085 |
| AA$_1$—AB$_1$<br>\\<br>AC<br>/<br>AA$_2$—AB$_2$ | NR |

TABLE 9

Integrin-binding peptide sequences

| Sequence/structure | SEQ ID NO: |
|---|---|
| RX$_1$ETX$_2$WX$_3$ | 441 |
| RX$_1$ETX$_2$WX$_3$ | 442 |
| RGDGX | 443 |
| CRGDGXC | 444 |
| CX$_1$X$_2$RLDX$_3$X$_4$C | 445 |
| CARRLDAPC | 446 |
| CPSRLDSPC | 447 |
| X$_1$X$_2$X$_3$RGDX$_4$X$_5$X$_6$ | 448 |
| CX$_2$CRGDCX$_5$C | 449 |
| CDCRGDCFC | 450 |

TABLE 9-continued

Integrin-binding peptide sequences

| Sequence/structure | SEQ ID NO: |
|---|---|
| CDCRGDCLC | 451 |
| CLCRGDCIC | 452 |
| X$_1$X$_2$DDX$_4$X$_5$X$_7$X$_8$ | 453 |
| X$_1$X$_2$X$_3$DDX$_4$X$_5$X$_6$X$_7$X$_8$ | 454 |
| CWDDGWLC | 455 |
| CWDDLWWLC | 456 |
| CWDDGLMC | 457 |
| CWDDGWMC | 458 |
| CSWDDGWLC | 459 |
| CPDDLWWLC | 460 |
| NGR | NR |
| GSL | NR |
| RGD | NR |
| CGRECPRLCQSSC | 1071 |
| CNGRCVSGCAGRC | 1072 |
| CLSGSLSC | 1073 |
| RGD | NR |
| NGR | NR |
| GSL | NR |
| NGRAHA | 1074 |
| CNGRC | 1075 |
| CDCRGDCFC | 1076 |
| CGSLVRC | 1077 |
| DLXXL | 1043 |
| RTDLDSLRTYTL | 1044 |
| RTDLDSLRTY | 1053 |
| RTDLDSLRT | 1054 |
| RTDLDSLR | 1078 |
| GDLDLLKLRLTL | 1079 |
| GDLHSLRQLLSR | 1080 |
| RDDLHMLRLQLW | 1081 |
| SSDLHALKKRYG | 1082 |
| RGDLKQLSELTW | 1083 |
| RGDLAALSAPPV | 1084 |

TABLE 10

Selectin antagonist peptide sequences

| Sequence/structure | SEQ ID NO: |
|---|---|
| DITWDQLWDLMK | 147 |
| DITWDELWKIMN | 148 |
| DYTWFELWDMMQ | 149 |
| QITWAQLWNMMK | 150 |
| DMTWHDLWTLMS | 151 |
| DYSWHDLWEMMS | 152 |
| EITWDQLWEVMN | 153 |
| HVSWEQLWDIMN | 154 |
| HITWDQLWRIMT | 155 |
| RNMSWLELWEHMK | 156 |
| AEWTWDQLWHVMNPAESQ | 157 |
| HRAEWLALWEQMSP | 158 |
| KKEDWLALWRIMSV | 159 |
| ITWDQLWDLMK | 160 |
| DITWDQLWDLMK | 161 |
| DITWDQLWDLMK | 162 |
| DITWDQLWDLMK | 163 |
| CQNRYTDLVAIQNKNE | 462 |
| AENWADNEPNNKRNNED | 463 |
| RKNNKTWTWVGTKKALTNE | 464 |
| KKALTNEAENWAD | 465 |
| CQXRYTDLVAIQNKXE | 466 |
| RKXNXXWTWVGTXKXLTEE | 467 |
| AENWADGEPNNKXNXED | 468 |
| CXXXYTXLVAIQNKXE | 469 |
| RKXXXXWXWVGTXKXLTXE | 470 |
| AXNWXXXEPNNXXXED | 471 |
| XKXKTXEAXNWXX | 472 |

TABLE 11

Antipathogenic peptide sequences

| Sequence/structure | SEQ ID NO: |
|---|---|
| GFFALIPKIISSPLFKTLLSAVGSALSSSGGQQ | 503 |
| GFFALIPKIISSPLFKTLLSAVGSALSSSGGQE | 504 |
| GFFALIPKIISSPLFKTLLSAV | 505 |
| GFFALIPKIISSPLFKTLLSAV | 506 |
| KGFFALIPKIISSPLFKTLLSAV | 507 |
| KKGFFALIPKIISSPLFKTLLSAV | 508 |
| KKGFFALIPKIISSPLFKTLLSAV | 509 |
| GFFALIPKIIS | 510 |
| GIGAVLKVLUGLPALISWIKRKRQQ | 511 |
| GIGAVLKVLTTGLPALISWIKRKRQQ | 512 |
| GIGAVLKVLTTGLPALISWIKRKRQQ | 513 |
| GIGAVLKVLTTGLPALISWIKR | 514 |
| AVLKVLTTGLPALISWIKR | 515 |
| KLLLLLKLLLLK | 516 |
| KLLLKLLLKLLK | 517 |
| KLLLKLKLKLLK | 518 |
| KKLLKLKLKLKK | 519 |
| KLLLKLLLKLLK | 520 |
| KLLLKLKLKLLK | 521 |
| KLLLLK | 522 |
| KLLLKLLK | 523 |
| KLLLKLKLKLLK | 524 |
| KLLLKLKLKLLK | 525 |
| KLLLKLKLKLLK | 526 |
| KAAAKAAAKAAK | 527 |
| KVVVKVVVKVVK | 528 |
| KVVVKVKVKVVK | 529 |
| KVVVKVKVKVK | 530 |
| KVVVKVKVKVVK | 531 |
| KLILKL | 532 |
| KVLHLL | 533 |
| LKLRLL | 534 |
| KPLHLL | 535 |
| KLILKLVR | 536 |
| KVFHLLHL | 537 |
| HKFRILKL | 538 |
| KPFHILHL | 539 |
| KIIIKIKIKIIK | 540 |
| KIIIKIKIKIIK | 541 |
| KIIIKIKIKIIK | 542 |
| KIPIKIKIKIPK | 543 |
| KIPIKIKIKIVK | 544 |
| RIIIRIRIRIIR | 545 |
| RIIIRIRIRIIR | 546 |
| RIIIRIRIRIIR | 547 |
| RIVIRIRIRLIR | 548 |
| RIIVRIRLRIIR | 549 |
| RIGIRLRVRIIR | 550 |
| KIVIRIRIRLIR | 551 |
| RIAVKWRLRFIK | 552 |
| KIGWKLRVRIIR | 553 |
| KKIGWLIIRVRR | 554 |
| RIVIRIRLRIRIR | 555 |
| RIIVRIRLRIIRVR | 556 |
| RIGIRLRVRIIRRV | 557 |
| KIVIRIRARLIRIRIR | 558 |
| RIIVKIRLRIIKKIRL | 559 |
| KIGIKARVRIIRVKII | 560 |
| RIIVHIRLRIIHHIRL | 561 |
| HIGIKAHVRIIRVHII | 562 |
| RIYVKIHLRYIKKIRL | 563 |
| KIGHKARVHIIRYKII | 564 |
| RIYVKPHPRYIKKIRL | 565 |
| KPGHKARPHIIRYKII | 566 |
| KIVIRIRIRLIRIRIRKIV | 567 |
| RIIVKIRLRIIKKIRLIKK | 568 |
| KIGWKLRVRIIRVKIGRLR | 569 |
| KIVIRIRIRLIRIRIRKIVKVKRIR | 570 |
| RFAVKIRLRIIKKIRLIKKIRKRVIK | 571 |
| KAGWKLRVRIIRVKIGRLRKIGWKKRVRIK | 572 |
| RIYVKPHPRYIKKIRL | 573 |
| KPGHKARPHIIRYKII | 574 |
| KIVIRIRLRIRIRKIV | 575 |
| RIIVKIRLRIIKKIRLIKK | 576 |
| RIYVSKISIYIKKIRL | 577 |
| KIVIFTRIRLTSIRIRSIV | 578 |
| KPIHKARPTIIRYKMI | 579 |
| cyclicCKGFFALIPKIISSPLFKTLLSAVC | 580 |
| CKKGFFALIPKIISSPLFKTLLSAVC | 581 |
| CKKKGFFALIPKIISSPLFKTLLSAVC | 582 |
| CyclicCRIVIRIRIRLIRIRC | 583 |
| CyclicCKPGHKARPHIIRYKIIC | 584 |
| CyclicCRFAVKIRLRIIKKIRLIKKIRKRVIKC | 585 |
| KLLLKLLL KLLKC | 586 |
| KLLLKLLLLKLLK | 587 |
| KLLLKLKLKLLKC | 588 |
| KLLLKLLLKLLK | 589 |

TABLE 12

VIP-mimetic peptide sequences

| Sequence/structure | SEQ ID NO: |
|---|---|
| HSDAVFYDNYTR LRKQMAVKKYLN SILN | 590 |
| Nle HSDAVFYDNYTR LRKQMAVKKYLN SILN | 591 |
| $X_1X_1'X_1''X_2$ | 592 |
| $X_3SX_4LN$ | 593 |
| NH CH CO KKYX5 NH CH CO X6<br>$\mid$ $\mid$<br>(CH2)$m$——Z——(CH2)$n$ | 594 |
| KKYL | 595 |
| NSILN | 596 |
| KKYL | 597 |
| KKYA | 598 |
| AVKKYL | 599 |
| NSILN | 600 |
| KKYV | 601 |
| SILauN | 602 |
| KKYLNle | 603 |
| NSYLN | 604 |
| NSIYN | 605 |
| KKYLPPNSILN | 606 |
| LauKKYL | 607 |
| CapKKYL | 608 |
| KYL | NR |
| KKYNle | 609 |
| VKKYL | 610 |
| LNSILN | 611 |
| YLNSILN | 612 |
| KKYLN | 613 |
| KKYLNS | 614 |
| KKYLNSI | 615 |
| KKYLNSIL | 616 |
| KKYL | 617 |
| KKYDA | 618 |
| AVKKYL | 619 |
| NSILN | 620 |
| KKYV | 621 |
| SILauN | 622 |
| NSYLN | 623 |
| NSIYN | 624 |
| KKYLNle | 625 |
| KKYLPPNSILN | 626 |
| KKYL | 627 |
| KKYDA | 628 |
| AVKKYL | 629 |
| NSILN | 630 |
| KKYV | 631 |
| SILauN | 632 |
| LauKKYL | 633 |
| CapKKYL | 634 |

TABLE 12-continued

VIP-mimetic peptide sequences

| Sequence/structure | SEQ ID NO: |
|---|---|
| KYL | NR |
| KYL | NR |
| KKYNle | 635 |
| VKKYL | 636 |
| LNSILN | 637 |
| YLNSILN | 638 |
| KKYLNle | 639 |
| KKYLN | 640 |
| KKYLNS | 641 |
| KKYLNSI | 642 |
| KKYLNSIL | 643 |
| KKKYLD | 644 |
| cyclicCKKYLC | 645 |
| CKKYLK / \ S—CH$_2$—CO | 646 |
| KKYA | 647 |
| WWTDTGLW | 648 |
| WWTDDGLW | 649 |
| WWDTRGLWVWTI | 650 |
| FWGNDGIWLESG | 651 |
| DWDQFGLWRGAA | 652 |
| RWDDNGLWVVVL | 653 |
| SGMWSHYGIWMG | 654 |
| GGRWDQAGLWVA | 655 |
| KLWSEQGIWMGE | 656 |
| CWSMHGLWLC | 657 |
| GCWDNTGIWVPC | 658 |
| DWDTRGLWVY | 659 |
| SLWDENGAWI | 660 |
| KWDDRGLWMH | 661 |
| QAWNERGLWT | 662 |
| QWDTRGLWVA | 663 |
| WNVHGIWQE | 664 |
| SWDTRGLWVE | 665 |
| DWDTRGLWVA | 666 |
| SWGRDGLWIE | 667 |
| EWTDNGLWAL | 668 |
| SWDEKGLWSA | 669 |
| SWDSSGLWMD | 670 |

TABLE 13

Mdm/hdm antagonist peptide sequences

| Sequence/structure | SEQ ID NO: |
|---|---|
| TFSDLW | 130 |
| QETFSDLWKLLP | 131 |
| QPTFSDLWKLLP | 132 |
| QETFSDYWKLLP | 133 |
| QPTFSDYWKLLP | 134 |
| MPRFMDYWEGLN | 135 |
| VQNFIDYWTQQF | 136 |
| TGPAFTHYWATF | 137 |
| IDRAPTFRDHWFALV | 138 |
| PRPALVFADYWETLY | 139 |
| PAFSRFWSDLSAGAH | 140 |
| PAFSRFWSKLSAGAH | 141 |
| PXFXDYWXXL | 142 |
| QETFSDLWKLLP | 143 |
| QPTFSDLWKLLP | 144 |
| QETFSDYWKLLP | 145 |
| QPTFSDYWKLLP | 146 |

TABLE 14

Calmodulin antagonist peptide sequences

| Sequence/structure | SEQ ID NO: |
|---|---|
| SCVKWGKKEFCGS | 164 |
| SCWKYWGKECGS | 165 |
| SCYEWGKLRWCGS | 166 |
| SCLRWGKWSNCGS | 167 |
| SCWRWGKYQICGS | 168 |
| SCVSWGALKLCGS | 169 |
| SCIRWGQNTFCGS | 170 |
| SCWQWGNLKICGS | 171 |
| SCVRWGQLSICGS | 172 |
| LKKFNARRKLKGAILTTMLAK | 173 |
| RRWKKNFIAVSAANRFKK | 174 |
| RKWQKTGHAVRAIGRLSS | 175 |
| INLKALAALAKKIL | 176 |
| KIWSILAPLGTTLVKLVA | 177 |
| LKKLLKLLKKLLKL | 178 |
| LKWKKLLKLLKKLLKKLL | 179 |
| AEWPSLTEIKTLSHFSV | 180 |
| AEWPSPTRVISTTYFGS | 181 |
| AELAHWPPVKTVLRSFT | 182 |
| AEGSWLQLLNLMKQMNN | 183 |
| AEWPSLTEIK | 184 |

TABLE 15

Mast cell antagonists/Mast cell protease inhibitor peptide sequences

| Sequence/structure | SEQ ID NO: |
|---|---|
| SGSGVLKRPLPILPVTR | 272 |
| RWLSSRPLPPLPLPPRT | 273 |
| GSGSYDTLALPSLPLHPMSS | 274 |
| GSGSYDTRALPSLPLHPMSS | 275 |
| GSGSSGVTMYPKLPPHWSMA | 276 |
| GSGSSGVRMYPKLPPHWSMA | 277 |
| GSGSSSMRMVPTIPGSAKHG | 278 |
| RNR | NR |
| QT | NR |
| RQK | NR |
| NRQ | NR |
| RQK | NR |
| RNRQKT | 436 |
| RNRQ | 437 |
| RNRQK | 438 |
| NRQKT | 439 |
| RQKT | 440 |

TABLE 16

SH3 antagonist peptide sequences

| Sequence/structure | SEQ ID NO: |
|---|---|
| RPLPPLP | 282 |
| RELPPLP | 283 |
| SPLPPLP | 284 |
| GPLPPLP | 285 |
| RPLPIPP | 286 |
| RPLPIPP | 287 |
| RRLPPTP | 288 |
| RQLPPTP | 289 |
| RPLPSRP | 290 |
| RPLPTRP | 291 |
| SRLPPLP | 292 |
| RALPSPP | 293 |

TABLE 16-continued

SH3 antagonist peptide sequences

| Sequence/structure | SEQ ID NO: |
|---|---|
| RRLPRTP | 294 |
| RPVPPIT | 295 |
| ILAPPVP | 296 |
| RPLPMLP | 297 |
| RPLPILP | 298 |
| RPLPSLP | 299 |
| RPLPSLP | 300 |
| RPLPMIP | 301 |
| RPLPLIP | 302 |
| RPLPPTP | 303 |
| RSLPPLP | 304 |
| RPQPPPP | 305 |
| RQLPIPP | 306 |
| XXXRPLPPLPXP | 307 |
| XXXRPLPPIPXX | 308 |
| XXXRPLPPLPXX | 309 |
| RXXRPLPPLPXP | 310 |
| RXXRPLPPLPPP | 311 |
| PPPYPPPPIPXX | 312 |
| PPPYPPPVPXX | 313 |
| LXXRPLPXΨP | 314 |
| ΨXXRPLPXLP | 315 |
| PPXθXPPPΨP | 316 |
| +PPΨPXKPXWL | 317 |
| RPXΨPΨYR+SXP | 318 |
| PPVPPRPXXTL | 319 |
| ΨPΨLPΨK | 320 |
| +θDXPLPXLP | 321 |

TABLE 17

Somatostatin or cortistatin mimetic peptide sequences

| Sequence/structure | SEQ ID NO: |
|---|---|
| X$^1$-X$^2$-Asn-Phe-Phe-Trp-Lys-Thr-Phe-X$^3$-Ser-X$^4$ | 473 |
| Asp Arg Met Pro Cys Arg Asn Phe Phe Trp Lys Thr Phe Ser Ser Cys Lys | 474 |
| Met Pro Cys Arg Asn Phe Phe Trp Lys Thr Phe Ser Ser Cys Lys | 475 |
| Cys Arg Asn Phe Phe Trp Lys Thr Phe Ser Ser Cys Lys | 476 |
| Asp Arg Met Pro Cys Arg Asn Phe Phe Trp Lys Thr Phe Ser Ser Cys | 477 |
| Met Pro Cys Arg Asn Phe Phe Trp Lys Thr Phe Ser Ser Cys | 478 |
| Cys Arg Asn Phe Phe Trp Lys Thr Phe Ser Ser Cys | 479 |
| Asp Arg Met Pro Cys Lys Asn Phe Phe Trp Lys Thr Phe Ser Ser Cys | 480 |
| Met Pro Cys Lys Asn Phe Phe Trp Lys Thr Phe Ser Ser Cys Lys | 481 |
| Cys Lys Asn Phe Phe Trp Lys Thr Phe Ser Ser Cys Lys | 482 |
| Asp Arg Met Pro Cys Lys Asn Phe Phe Trp Lys Thr Phe Ser Ser Cys | 483 |
| Met Pro Cys Lys Asn Phe Phe Trp Lys Thr Phe Ser Ser Cys | 484 |
| Cys Lys Asn Phe Phe Trp Lys Thr Phe Ser Ser Cys | 485 |
| Asp Arg Met Pro Cys Arg Asn Phe Phe Trp Lys Thr Phe Thr Ser Cys Lys | 486 |
| Met Pro Cys Arg Asn Phe Phe Trp Lys Thr Phe Thr Ser Cys Lys | 487 |
| Cys Arg Asn Phe Phe Trp Lys Thr Phe Thr Ser Cys Lys | 488 |
| Asp Arg Met Pro Cys Arg Asn Phe Phe Trp Lys Thr Phe Thr Ser Cys | 489 |
| Met Pro Cys Arg Asn Phe Phe Trp Lys Thr Phe Thr Ser Cys | 490 |
| Cys Arg Asn Phe Phe Trp Lys Thr Phe Thr Ser Cys | 491 |
| Asp Arg Met Pro Cys Lys Asn Phe Phe Trp Lys Thr Phe Thr Ser Cys Lys | 492 |
| Met Pro Cys Lys Asn Phe Phe Trp Lys Thr Phe Thr Ser Cys Lys | 493 |
| Cys Lys Asn Phe Phe Trp Lys Thr Phe Thr Ser Cys Lys | 494 |
| Asp Arg Met Pro Cys Lys Asn Phe Phe Trp Lys Thr Phe Thr Ser Cys | 495 |
| Met Pro Cys Lys Asn Phe Phe Trp Lys Thr Phe Thr Ser Cys | 496 |
| Cys Lys Asn Phe Phe Trp Lys Thr Phe Thr Ser Cys | 497 |

TABLE 18

UKR antagonist peptide sequences

| Sequence/structure | SEQ ID NO: |
|---|---|
| AEPMPHSLNFSQYLWYT | 196 |
| AEHTYSSLWDTYSPLAF | 197 |
| AELDLWMRHYPLSFSNR | 198 |
| AESSLWTRYAWPSMPSY | 199 |
| AEWHPGLSFGSYLWSKT | 200 |
| AEPALLNWSFFFNPGLH | 201 |
| AEWSFYNLHLPEPQTIF | 202 |
| AEPLDLWSLYSLPPLAM | 203 |
| AEPTLWQLYQFPLRLSG | 204 |
| AEISFSELMWLRSTPAF | 205 |
| AELSEADLWTTWFGMGS | 206 |
| AESSLWRIFSPSALMMS | 207 |
| AESLPTLTSILWGKESV | 208 |
| AETLFMDLWHDKHILLT | 209 |
| AEILNFPLWHEPLWSTE | 210 |
| AESQTGTLNTLFWNTLR | 211 |
| AEPVYQYELDSYLRSYY | 430 |
| AELDLSTFYDIQYLLRT | 431 |
| AEFFKLGPNGYVYLHSA | 432 |
| FKLXXXGYVYL | 433 |
| AESTYHHLSLGYMYTLN | 434 |
| YHXLXXGYMYT | 435 |

TABLE 19

Macrophage and/or T-cell inhibiting peptide sequences

| Sequence/structure | SEQ ID NO: |
|---|---|
| Xaa-Yaa-Arg | NR |
| Arg-Yaa-Xaa | NR |
| Xaa-Arg-Yaa | NR |
| Yaa-Arg-Xaa | NR |
| Ala-Arg | NR |
| Arg-Arg | NR |
| Asn-Arg | NR |
| Asp-Arg | NR |
| Cys-Arg | NR |
| Gln-Arg | NR |
| Glu-Arg | NR |
| Gly-Arg | NR |
| His-arg | NR |
| Ile-Arg | NR |
| Leu-Arg | NR |
| Lys-Arg | NR |
| Met-Arg | NR |
| Phe-Arg | NR |
| Ser-Arg | NR |
| Thr-Arg | NR |
| Trp-Arg | NR |
| Tyr-Arg | NR |
| Val-Arg | NR |
| Ala-Glu-Arg | NR |
| Arg-Glu-Arg | NR |
| Asn-Glu-Arg | NR |
| Asp-Glu-Arg | NR |
| Cys-Glu-Arg | NR |
| Gln-Glu-Arg | NR |
| Glu-Glu-Arg | NR |
| Gly-Glu-Arg | NR |
| His-Glu-Arg | NR |
| Ile-Glu-Arg | NR |
| Leu-Glu-Arg | NR |
| Lys-Glu-Arg | NR |
| Met-Glu-Arg | NR |
| Phe-Glu-Arg | NR |
| Pro-Glu-Arg | NR |
| Ser-Glu-Arg | NR |
| Thr-Glu-Arg | NR |
| Trp-Glu-Arg | NR |
| Tyr-Glu-Arg | NR |
| Val-Glu-Arg | NR |
| Arg-Ala | NR |
| Arg-Asp | NR |
| Arg-Cys | NR |
| Arg-Gln | NR |
| Arg-Glu | NR |
| Arg-Gly | NR |
| Arg-His | NR |
| Arg-Ile | NR |
| Arg-Leu | NR |
| Arg-Lys | NR |
| Arg-Met | NR |
| Arg-Phe | NR |
| Arg-Pro | NR |
| Arg-Ser | NR |
| Arg-Thr | NR |
| Arg-Trp | NR |
| Arg-Tyr | NR |
| Arg-Val | NR |
| Arg-Glu-Ala | NR |
| Arg-Glu-Asn | NR |
| Arg-Glu-Asp | NR |
| Arg-Glu-Cys | NR |
| Arg-Glu-Gln | NR |
| Arg-Glu-Glu | NR |
| Arg-Glu-Gly | NR |
| Arg-Glu-His | NR |

TABLE 19-continued

Macrophage and/or T-cell inhibiting peptide sequences

| Sequence/structure | SEQ ID NO: |
|---|---|
| Arg-Glu-Ile | NR |
| Arg-Glu-Leu | NR |
| Arg-Glu-Lys | NR |
| Arg-Glu-Met | NR |
| Arg-Glu-Phe | NR |
| Arg-Glu-Pro | NR |
| Arg-Glu-Ser | NR |
| Arg-Glu-Thr | NR |
| Arg-Glu-Trp | NR |
| Arg-Glu-Tyr | NR |
| Arg-Glu-Val | NR |
| Ala-Arg-Glu | NR |
| Arg-Arg-Glu | NR |
| Asn-Arg-Glu | NR |
| Asp-Arg-Glu | NR |
| Cys-Arg-Glu | NR |
| Gln-Arg-Glu | NR |
| Glu-Arg-Glu | NR |
| Gly-Arg-Glu | NR |
| His-Arg-Glu | NR |
| Ile-Arg-Glu | NR |
| Leu-Arg-Glu | NR |
| Lys-Arg-Glu | NR |
| Met-Arg-Glu | NR |
| Phe-Arg-Glu | NR |
| Pro-Arg-Glu | NR |
| Ser-Arg-Glu | NR |
| Thr-Arg-Glu | NR |
| Trp-Arg-Glu | NR |
| Tyr-Arg-Glu | NR |
| Val-Arg-Glu | NR |
| Glu-Arg-Ala, | NR |
| Glu-Arg-Arg | NR |
| Glu-Arg-Asn | NR |
| Glu-Arg-Asp | NR |
| Glu-Arg-Cys | NR |
| Glu-Arg-Gln | NR |
| Glu-Arg-Gly | NR |
| Glu-Arg-His | NR |
| Glu-Arg-Ile | NR |
| Glu-Arg-Leu | NR |
| Glu-Arg-Lys | NR |
| Glu-Arg-Met | NR |
| Glu-Arg-Phe | NR |
| Glu-Arg-Pro | NR |
| Glu-Arg-Ser | NR |
| Glu-Arg-Thr | NR |
| Glu-Arg-Trp | NR |
| Glu-Arg-Tyr | NR |
| Glu-Arg-Val | NR |

TABLE 20

Additional Exemplary Pharmacologically Active Peptides

| Sequence/structure | SEQ ID NO: | Activity |
|---|---|---|
| VEPNCDIHVMWEWECFERL | 1027 | VEGF-antagonist |
| GERWCFDGPLTWVCGEES | 398 | VEGF-antagonist |
| RGWVEICVADDNGMCVTEAQ | 1085 | VEGF-antagonist |
| GWDECDVARMWEWECFAGV | 1086 | VEGF-antagonist |
| GERWCFDGPRAWVCGWEI | 501 | VEGF-antagonist |
| EELWCFDGPRAWVCGYVK | 502 | VEGF-antagonist |
| RGWVEICAADDYGRCLTEAQ | 1031 | VEGF-antagonist |
| RGWVEICESDVWGRCL | 1087 | VEGF-antagonist |
| RGWVEICESDVWGRCL | 1088 | VEGF-antagonist |
| GGNECDIARMWEWECFERL | 1089 | VEGF-antagonist |
| RGWVEICAADDYGRCL | 1090 | VEGF-antagonist |
| CTTHWGFTLC | 1028 | MMP inhibitor |
| CLRSGXGC | 1091 | MMP inhibitor |
| CXXHWGFXXC | 1092 | MMP inhibitor |
| CXPXC | 1093 | MMP inhibitor |
| CRRHWGFEFC | 1094 | MMP inhibitor |
| STTHWGFTLS | 1095 | MMP inhibitor |
| CSLHWGFWWC | 1096 | CTLA4-mimetic |
| GFVCSGIFAVGVGRC | 125 | CTLA4-mimetic |
| APGVRLGCAVLGRYC | 126 | CTLA4-mimetic |
| LLGRMK | 105 | Antiviral (HBV) |
| ICVVQDWGHHRCTAGHMANLTSHASAI | 127 | C3b antagonist |
| ICVVQDWGHHRCT | 128 | C3b antagonist |
| CVVQDWGHHAC | 129 | C3b antagonist |
| STGGFDDVYDWARGVSSALTTTLVATR | 185 | Vinculin-binding |
| STGGFDDVYDWARRVSSALTTTLVATR | 186 | Vinculin-binding |
| SRGVNFSEWLYDMSAAMKEASNVFPSRRSR | 187 | Vinculin-binding |
| SSQNWDMEAGVEDLTAAMLGLLSTIHSSSR | 188 | Vinculin-binding |
| SSPSLYTQFLVNYESAATRIQDLLIASRPSR | 189 | Vinculin-binding |
| SSTGWVDLLGALQRAADATRTSIPPSLQNSR | 190 | Vinculin-binding |
| DVYTKKELIECARRVSEK | 191 | Vinculin-binding |
| EKGSYYPGSGIAQFHIDYNNVS | 192 | C4BP-binding |
| SGIAQFHIDYNNVSSAEGWHVN | 193 | C4BP-binding |
| LVTVEKGSYYPGSGIAQFHIDYNNVSSAEGWHVN | 194 | C4BP-binding |
| SGIAQFHIDYNNVS | 195 | C4BP-binding |
| LLGRMK | 279 | anti-HBV |
| ALLGRMKG | 280 | anti-HBV |
| LDPAFR | 281 | anti-HBV |
| CXXRGDC | 322 | Inhibition of platelet aggregation |
| RPLPPLP | 323 | Src antagonist |
| PPVPPR | 324 | Src antagonist |
| XFXDXWXXLXX | 325 | Anti-cancer (particularly for sarcomas) |
| KACRRLFGPVDSEQLSRDCD | 326 | p16-mimetic |
| RERWNFDFVTETPLEGDFAW | 327 | p16-mimetic |
| KRRQTSMTDFYHSKRRLIFS | 328 | p16-mimetic |
| TSMTDFYHSKRRLIFSKRKP | 329 | p16-mimetic |
| RRLIF | 330 | p16-mimetic |
| KRRQTSATDFYHSKRRLIFSRQIKIWFQNRRMKWKK | 331 | p16-mimetic |
| KRRLIFSKRQIKIWFQNRRMKWKK | 332 | p16-mimetic |
| Asn Gln Gly Arg His Phe Cys Gly Gly Ala Leu Ile His Ala Arg Phe Val Met Thr Ala Ala Ser Cys Phe Gln | 498 | CAP37 mimetic/LPS binding |
| Arg His Phe Cys Gly Gly Ala Leu Ile His Ala Arg Phe Val Met Thr Ala Ala Ser Cys | 499 | CAP37 mimetic/LPS binding |
| Gly Thr Arg Cys Gln Val Ala Gly Trp Gly Ser Gln Arg Ser Gly Gly Arg Leu Ser Arg Phe Pro Arg Phe Val Asn Val | 500 | CAP37 mimetic/LPS binding |
| WHWRHRIPLQLAAGR | 1097 | carbohydrate (GD1 alpha) mimetic |
| LKTPRV | 1098 | β2GPI Ab binding |
| NTLKTPRV | 1099 | β2GPI Ab binding |
| NTLKTPRVGGC | 1100 | β2GPI Ab binding |
| KDKATF | 1101 | β2GPI Ab binding |
| KDKATFGCHD | 1102 | β2GPI Ab binding |
| KDKATFGCHDGC | 1103 | β2GPI Ab binding |
| TLRVYK | 1104 | β2GPI Ab binding |
| ATLRVYKGG | 1105 | β2GPI Ab binding |
| CATLRVYKGG | 1106 | β2GPI Ab binding |
| INLKALAALAKKIL | 1107 | Membrane-transporting |
| GWT | NR | Membrane-transporting |
| GWTLNSAGYLLG | 1108 | Membrane-transporting |
| GWTLNSAGYLLGKINLKALAALAKKIL | 1109 | Membrane-transporting |

The present invention is also particularly useful with peptides having activity in treatment of:
  cancer, wherein the peptide is a VEGF-mimetic or a VEGF receptor antagonist, a HER2 agonist or antagonist, a CD20 antagonist and the like;
  asthma, wherein the protein of interest is a CKR3 antagonist, an IL-5 receptor antagonist, and the like;
  thrombosis, wherein the protein of interest is a GPIIb antagonist, a GPIIIa antagonist, and the like;
  autoimmune diseases and other conditions involving immune modulation, wherein the protein of interest is an IL-2 receptor antagonist, a CD40 agonist or antagonist, a CD40L agonist or antagonist, a thymopoietin mimetic and the like.

Vehicles. This invention requires the presence of at least one vehicle ($F^1$, $F^2$) attached to a peptide through the N-terminus, C-terminus or a sidechain of one of the amino acid residues. Multiple vehicles may also be used; e.g., Fc's at each terminus or an Fc at a terminus and a PEG group at the other terminus or a sidechain.

An Fc domain is the preferred vehicle. The Fc domain may be fused to the N or C termini of the peptides or at both the N and C termini. For the TPO-mimetic peptides, molecules having the Fc domain fused to the N terminus of the peptide portion of the molecule are more bioactive than other such fusions, so fusion to the N terminus is preferred.

As noted above, Fc variants are suitable vehicles within the scope of this invention. A native Fc may be extensively modified to form an Fc variant in accordance with this invention, provided binding to the salvage receptor is maintained; see, for example WO 97/34631 and WO 96/32478. In such Fc variants, one may remove one or more sites of a native Fc that provide structural features or functional activity not required by the fusion molecules of this invention. One may remove these sites by, for example, substituting or deleting residues, inserting residues into the site, or truncating portions containing the site. The inserted or substituted residues may also be altered amino acids, such as peptidomimetics or D-amino acids. Fc variants may be desirable for a number of reasons, several of which are described below. Exemplary Fc variants include molecules and sequences in which:

1. Sites involved in disulfide bond formation are removed. Such removal may avoid reaction with other cysteine-containing proteins present in the host cell used to produce the molecules of the invention. For this purpose, the cysteine-containing segment at the N-terminus may be truncated or cysteine residues may be deleted or substituted with other amino acids (e.g., alanyl, seryl). In particular, one may truncate the N-terminal 20-amino acid segment of SEQ ID NO: 2 or delete or substitute the cysteine residues at positions 7 and 10 of SEQ ID NO: 2. Even when cysteine residues are removed, the single chain Fc domains can still form a dimeric Fc domain that is held together non-covalently.
2. A native Fc is modified to make it more compatible with a selected host cell. For example, one may remove the PA sequence near the N-terminus of a typical native Fc, which may be recognized by a digestive enzyme in *E. coli* such as proline iminopeptidase. One may also add an N-terminal methionine residue, especially when the molecule is expressed recombinantly in a bacterial cell such as *E. coli*. The Fc domain of SEQ ID NO: 2 (FIG. 4) is one such Fc variant.
3. A portion of the N-terminus of a native Fc is removed to prevent N-terminal heterogeneity when expressed in a selected host cell. For this purpose, one may delete any of the first 20 amino acid residues at the N-terminus, particularly those at positions 1, 2, 3, 4 and 5.
4. One or more glycosylation sites are removed. Residues that are typically glycosylated (e.g., asparagine) may confer cytolytic response. Such residues may be deleted or substituted with unglycosylated residues (e.g., alanine).
5. Sites involved in interaction with complement, such as the C1q binding site, are removed. For example, one may delete or substitute the EKK sequence of human IgG1. Complement recruitment may not be advantageous for the molecules of this invention and so may be avoided with such an Fc variant.
6. Sites are removed that affect binding to Fc receptors other than a salvage receptor. A native Fc may have sites for interaction with certain white blood cells that are not required for the fusion molecules of the present invention and so may be removed.
7. The ADCC site is removed. ADCC sites are known in the art; see, for example, *Molec. Immunol.* 29 (5): 633–9 (1992) with regard to ADCC sites in IgG1. These sites, as well, are not required for the fusion molecules of the present invention and so may be removed.
8. When the native Fc is derived from a non-human antibody, the native Fc may be humanized. Typically, to humanize a native Fc, one will substitute selected residues in the non-human native Fc with residues that are normally found in human native Fc. Techniques for antibody humanization are well known in the art.

Preferred Fc variants include the following. In SEQ ID NO: 2 (FIG. 4) the leucine at position 15 may be substituted with glutamate; the glutamate at position 99, with alanine; and the lysines at positions 101 and 103, with alanines. In addition, one or more tyrosine residues can be replaced by phenylalanine residues.

An alternative vehicle would be a protein, polypeptide, peptide, antibody, antibody fragment, , or small molecule (e.g., a peptidomimetic compound) capable of binding to a salvage receptor. For example, one could use as a vehicle a polypeptide as described in U.S. Pat. No. 5,739,277, issued Apr. 14, 1998 to Presta et al. Peptides could also be selected by phage display for binding to the FcRn salvage receptor. Such salvage receptor-binding compounds are also included within the meaning of "vehicle" and are within the scope of this invention. Such vehicles should be selected for increased half-life (e.g., by avoiding sequences recognized by proteases) and decreased immunogenicity (e.g., by favoring non-immunogenic sequences, as discovered in antibody humanization).

As noted above, polymer vehicles may also be used for $F^1$ and $F^2$. Various means for attaching chemical moieties useful as vehicles are currently available, see e.g., Patent Cooperation Treaty ("PCT") International Publication No. WO 96/11953, entitled "N-Terminally Chemically Modified Protein Compositions and Methods," herein incorporated by reference in its entirety. This PCT publication discloses, among other things, the selective attachment of water soluble polymers to the N-terminus of proteins.

A preferred polymer vehicle is polyethylene glycol (PEG). The PEG group may be of any convenient molecular weight and may be linear or branched. The average molecular weight of the PEG will preferably range from about 2 kiloDalton ("kD") to about 100 kDa, more preferably from about 5 kDa to about 50 kDa, most preferably from about 5 kDa to about kDa. The PEG groups will generally be attached to the compounds of the invention via acylation or reductive alkylation through a reactive group on the PEG moiety (e.g., an aldehyde, amino, thiol, or ester group) to a reactive group on the inventive compound (e.g., an aldehyde, amino, or ester group).

Figure 2A:
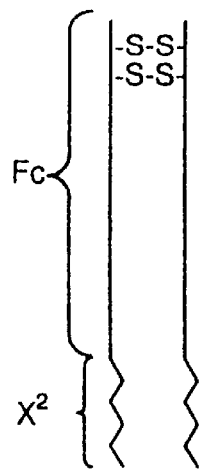
In FIG. 2A, the Fc domain is linked at the amino terminus of the peptides; in 2D, at the carboxyl terminus.
- B, E: Doubly disulfide-bonded dimers. This Fc domain may be formed by truncation of the parent antibody to retain both cysteinyl residues in the Fc domain chains or by expression from a construct including a sequence encoding such an Fc domain.
Figure 2B:
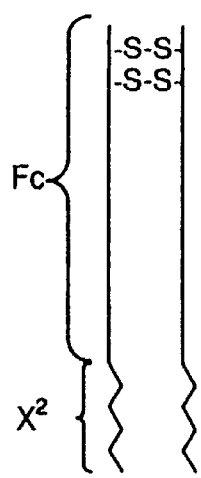
In FIG. 2B, the Fc domain is linked at the amino terminus of the peptides; in 2E, at the carboxyl terminus.
- C, F: Noncovalent dimers. This Fc domain may be formed by elimination of the cysteinyl residues by either truncation or substitution. One may desire to eliminate the cysteinyl residues to avoid impurities formed by reaction of the cysteinyl residue with cysteinyl residues of other proteins present in the host cell. The noncovalent bonding of the Fc domains is sufficient to hold together the dimer. Other dimers may be formed by using Fc domains derived from different types of antibodies (e.g., IgG2, IgM).
Figure 2C:
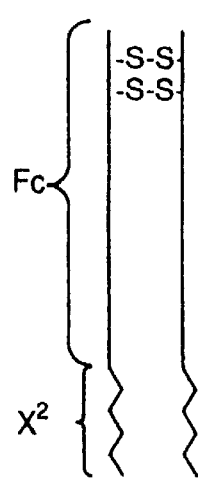
FIG. 2 shows exemplary Fc dimers that may be derived from an IgG1 antibody. "Fc" in the figure represents any of the Fc variants within the meaning of "Fc domain" herein. "$X^1$" and "$X^2$" represent peptides or linker-peptide combinations as defined hereinafter. The specific dimers are as follows.
Figure 2D:
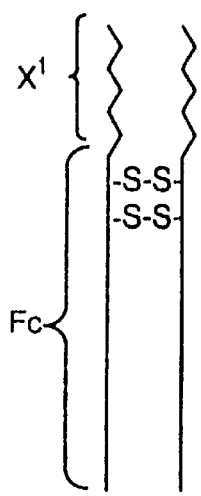
Figure 2E:
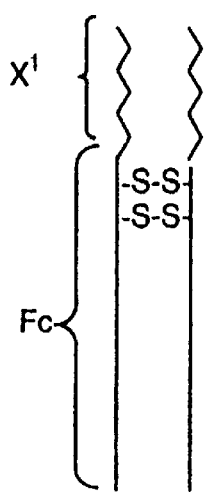
Figure 2F:
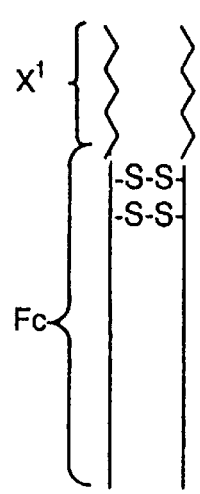
Figure 3A:
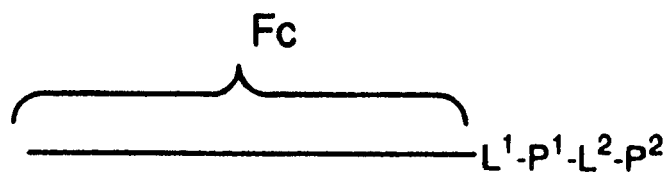
FIG. 3A shows a single chain molecule and may also represent the DNA construct for the molecule.
Figure 3B:
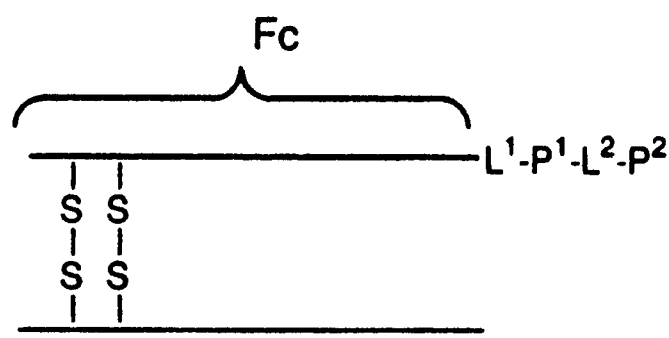
FIG. 3B shows a dimer in which the linker-peptide portion is present on only one chain of the dimer.
Figure 3C:
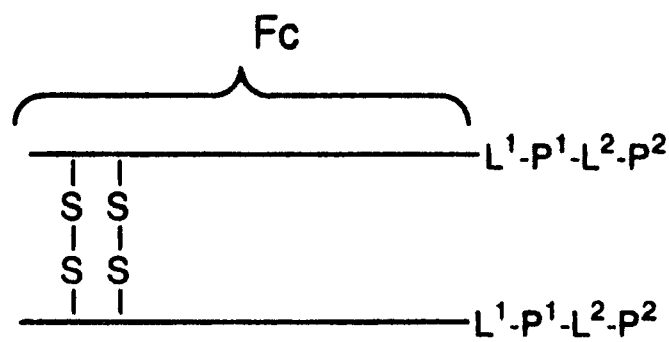
FIG. 3C shows a dimer having the peptide portion on both chains. The dimer of FIG. 3C will form spontaneously in certain host cells upon expression of a DNA construct encoding the single chain shown in FIG. 3A. In other host cells, the cells could be placed in conditions favoring formation of dimers or the dimers can be formed in vitro.
Figure 5:
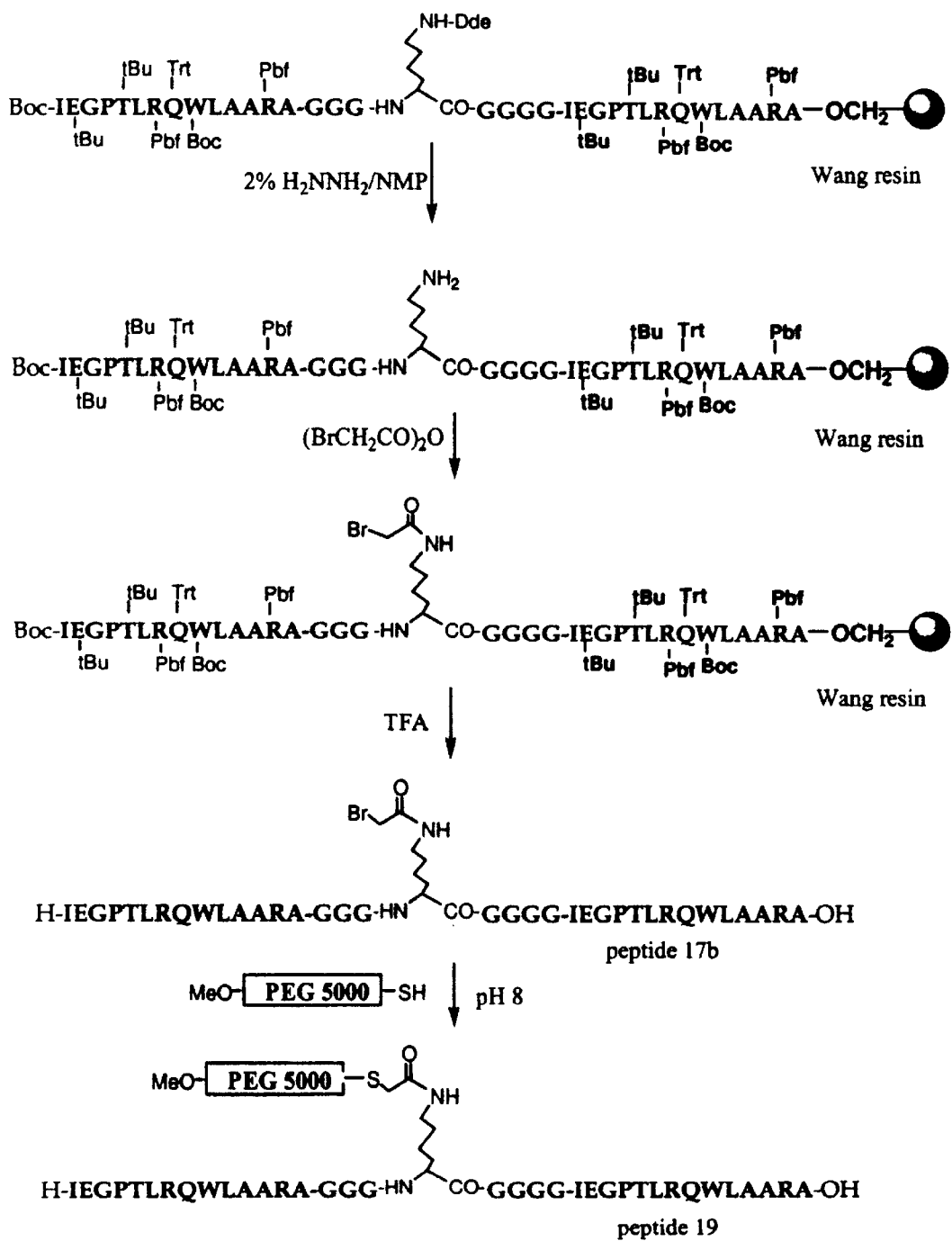
FIG. 5 shows a synthetic scheme for the preparation of PEGylated peptide 19 (SEQ ID NO: 3) as prepared through intermediates having SEQ ID NOS: 1128 through 1131, respectively.

A useful strategy for the PEGylation of synthetic peptides consists of combining, through forming a conjugate linkage in solution, a peptide and a PEG moiety, each bearing a special functionality that is mutually reactive toward the other. The peptides can be easily prepared with conventional solid phase synthesis (see, for example, FIGS. 5 and 6 and the accompanying text herein). The peptides are "preactivated" with an appropriate functional group at a specific site. The precursors are purified and fully characterized prior to reacting with the PEG moiety. Ligation of the peptide with PEG usually takes place in aqueous phase and can be easily monitored by reverse phase analytical HPLC. The PEGylated peptides can be easily purified by preparative HPLC and characterized by analytical HPLC, amino acid analysis and laser desorption mass spectrometry.

Polysaccharide polymers are another type of water soluble polymer which may be used for protein modification. Dextrans are polysaccharide polymers comprised of individual subunits of glucose predominantly linked by α1–6 linkages. The dextran itself is available in many molecular weight ranges, and is readily available in molecular weights from about 1 kD to about 70 kD. Dextran is a suitable water soluble polymer for use in the present invention as a vehicle by itself or in combination with another vehicle (e.g., Fc). See, for example, WO 96/11953 and WO 96/05309. The use of dextran conjugated to therapeutic or diagnostic immunoglobulins has been reported; see, for example, European Patent Publication No. 0 315 456, which is hereby incorporated by reference. Dextran of about 1 kD to about 20 kD is preferred when dextran is used as a vehicle in accordance with the present invention.

Linkers. Any "linker" group is optional. When present, its chemical structure is not critical, since it serves primarily as a spacer. The linker is preferably made up of amino acids linked together by peptide bonds. Thus, in preferred embodiments, the linker is made up of from 1 to 20 amino acids linked by peptide bonds, wherein the amino acids are selected from the 20 naturally occurring amino acids. Some of these amino acids may be glycosylated, as is well understood by those in the art. In a more preferred embodiment, the 1 to 20 amino acids are selected from glycine, alanine, proline, asparagine, glutamine, and lysine. Even more preferably, a linker is made up of a majority of amino acids that are sterically unhindered, such as glycine and alanine. Thus, preferred linkers are polyglycines (particularly (Gly)$_4$, (Gly)$_5$), poly(Gly-Ala), and polyalanines. Other specific examples of linkers are:

(Gly)$_3$Lys(Gly)$_4$ (SEQ ID NO: 333);
(Gly)$_3$AsnGlySer(Gly)$_2$ (SEQ ID NO: 334);
(Gly)$_3$Cys(Gly)$_4$ (SEQ ID NO: 335); and
GlyProAsnGlyGly (SEQ ID NO: 336).

To explain the above nomenclature, for example, (Gly)$_3$Lys(Gly)$_4$ means Gly-Gly-Gly-Lys-Gly-Gly-Gly-Gly. Combinations of Gly and Ala are also preferred. The linkers shown here are exemplary; linkers within the scope of this invention may be much longer and may include other residues.

Non-peptide linkers are also possible. For example, alkyl linkers such as —NH—(CH$_2$)$_s$—C(O)—, wherein s=2–20 could be used. These alkyl linkers may further be substituted by any non-sterically hindering group such as lower alkyl (e.g., C$_1$–C$_6$) lower acyl, halogen (e.g., Cl, Br), CN, NH$_2$, phenyl, etc. An exemplary non-peptide linker is a PEG linker,

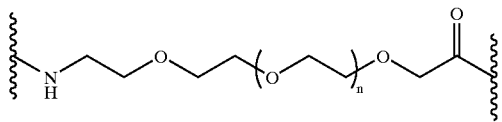

VI wherein n is such that the linker has a molecular weight of 100 to 5000 kD, preferably 100 to 500 kD. The peptide linkers may be altered to form derivatives in the same manner as described above.

Derivatives. The inventors also contemplate derivatizing the peptide and/or vehicle portion of the compounds. Such derivatives may improve the solubility, absorption, biological half life, and the like of the compounds. The moieties may alternatively eliminate or attenuate any undesirable side-effect of the compounds and the like. Exemplary derivatives include compounds in which:

1. The compound or some portion thereof is cyclic. For example, the peptide portion may be modified to contain two or more Cys residues (e.g., in the linker), which could cyclize by disulfide bond formation. For citations to references on preparation of cyclized derivatives, see Table 2.

2. The compound is cross-linked or is rendered capable of cross-linking between molecules. For example, the peptide portion may be modified to contain one Cys residue and thereby be able to form an intermolecular disulfide bond with a like molecule. The compound may also be cross-linked through its C-terminus, as in the molecule shown below.

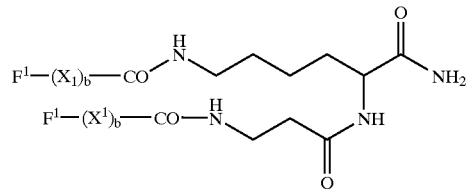

VII

4. One or more peptidyl [—C(O)NR—] linkages (bonds) is replaced by a non-peptidyl linkage. Exemplary non-peptidyl linkages are —CH$_2$-carbamate [—CH$_2$—OC(O)NR—], phosphonate, —CH$_2$-sulfonamide [—CH$_2$—S(O)$_2$NR—], urea [—NHC(O)NH—], —CH$_2$-secondary amine, and alkylated peptide [—C(O)NR$^6$— wherein R$^6$ is lower alkyl].

5. The N-terminus is derivatized. Typically, the N-terminus may be acylated or modified to a substituted amine. Exemplary N-terminal derivative groups include —NRR$^1$ (other than —NH$_2$), —NRC(O)R$^4$, —NRC(O)OR$^1$, —NRS(O)$_2$R$^1$, —NHC(O)NHR$^1$, succinimide, or benzyloxycarbonyl-NH— (CBZ—NH—), wherein R and R$^1$ are each independently hydrogen or lower alkyl and wherein the phenyl ring may be substituted with 1 to 3 substituents selected from the group consisting of C$_1$–C$_4$ alkyl, C$_1$–C$_4$ alkoxy, chloro, and bromo.

6. The free C-terminus is derivatized. Typically, the C-terminus is esterified or amidated. For example, one may use methods described in the art to add (NH—CH$_2$—CH$_2$—NH$_2$)$_2$ to compounds of this invention having any of SEQ ID NOS: 504 to 508 at the C-terminus. Likewise, one may use methods described in the art to add —NH$_2$ to compounds of this invention having any of SEQ ID NOS: 924 to 955, 963 to 972, 1005 to 1013, or 1018 to 1023 at the C-terminus. Exemplary C-terminal derivative groups include, for example, —C(O)R$^2$ wherein R$^2$ is lower alkoxy or —NR$^3$R$^4$ wherein R$^3$ and R$^4$ are independently hydrogen or C$_1$–C$_8$ alkyl (preferably C$_1$–C$_4$ alkyl).

7. A disulfide bond is replaced with another, preferably more stable, cross-linking moiety (e.g., an alkylene). See, e.g., Bhatnagar et al. (1996), *J. Med. Chem.* 39: 3814–9; Alberts et al. (1993) *Thirteenth Am. Pep. Symp.*, 357–9.

8. One or more individual amino acid residues is modified. Various derivatizing agents are known to react specifically with selected sidechains or terminal residues, as described in detail below.

Lysinyl residues and amino terminal residues may be reacted with succinic or other carboxylic acid anhydrides, which reverse the charge of the lysinylresidues. Other suitable reagents for derivatizing alpha-amino-containing residues include imidoesters such as methyl picolinimidate; pyridoxal phosphate; pyridoxal; chloroborohydride; trinitrobenzenesulfonic acid; O-methylisourea; 2,4 pentanedione; and transaminase-catalyzed reaction with glyoxylate.

Arginyl residues may be modified by reaction with any one or combination of several conventional reagents, including phenylglyoxal, 2,3-butanedione, 1,2-cyclohexanedione, and ninhydrin. Derivatization of arginyl residues requires that the reaction be performed in alkaline conditions because of the high pKa of the guanidine functional group. Furthermore, these reagents may react with the groups of lysine as well as the arginine epsilon-amino group.

Specific modification of tyrosyl residues has been studied extensively, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively.

Carboxyl sidechain groups (aspartyl or glutamyl) may be selectively modified by reaction with carbodiimides (R'—N=C=N—R') such as 1-cyclohexyl-3-(2-morpholinyl-(4-ethyl) carbodiimide or 1-ethyl-3-(4-azonia-4,4-dimethylpentyl) carbodiimide. Furthermore, aspartyl and glutamyl residues may be converted to asparaginyl and glutaminyl residues by reaction with ammonium ions.

Glutaminyl and asparaginyl residues may be deamidated to the corresponding glutamyl and aspartyl residues. Alternatively, these residues are deamidated under mildly acidic conditions. Either form of these residues falls within the scope of this invention.

Cysteinyl residues can be replaced by amino acid residues or other moieties either to eliminate disulfide bonding or, conversely, to stabilize cross-linking. See, e.g., Bhatnagar et al. (1996), *J. Med. Chem.* 39: 3814–9.

Derivatization with bifunctional agents is useful for cross-linking the peptides or their functional derivatives to a water-insoluble support matrix or to other macromolecular vehicles. Commonly used cross-linking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis (succinimidylpropionate), and bifunctional maleimides such as bis-N-maleimido-1,8-octane. Derivatizing agents such as methyl-3-[(p-azidophenyl)dithio]propioimidate yield photo-activatable intermediates that are capable of forming crosslinks in the presence of light. Alternatively, reactive water-insoluble matrices such as cyanogen bromide-activated carbohydrates and the reactive substrates described in U.S. Pat. Nos. 3,969,287; 3,691,016; 4,195,128; 4,247,642; 4,229,537; and 4,330,440 are employed for protein immobilization.

Carbohydrate (oligosaccharide) groups may conveniently be attached to sites that are known to be glycosylation sites in proteins. Generally, O-linked oligosaccharides are attached to serine (Ser) or threonine (Thr) residues while N-linked oligosaccharides are attached to asparagine (Asn) residues when they are part of the sequence Asn-X-Ser/Thr, where X can be any amino acid except proline. X is preferably one of the 19 naturally occurring amino acids other than proline. The structures of N-linked and O-linked oligosaccharides and the sugar residues found in each type are different. One type of sugar that is commonly found on both is N-acetylneuraminic acid (referred to as sialic acid). Sialic acid is usually the terminal residue of both N-linked and O-linked oligosaccharides and, by virtue of its negative charge, may confer acidic properties to the glycosylated compound. Such site(s) may be incorporated in the linker of the compounds of this invention and are preferably glycosylated by a cell during recombinant production of the polypeptide compounds (e.g., in mammalian cells such as CHO, BHK, COS). However, such sites may further be glycosylated by synthetic or semi-synthetic procedures known in the art.

Other possible modifications include hydroxylation of proline and lysine, phosphorylation of hydroxyl groups of seryl or threonyl residues, oxidation of the sulfur atom in Cys, methylation of the alpha-amino groups of lysine, arginine, and histidine side chains. Creighton, *Proteins: Structure and Molecule Properties* (W. H. Freeman & Co., San Francisco), pp. 79–86 (1983).

Compounds of the present invention may be changed at the DNA level, as well. The DNA sequence of any portion of the compound may be changed to codons more compatible with the chosen host cell. For *E. coli*, which is the preferred host cell, optimized codons are known in the art. Codons may be substituted to eliminate restriction sites or to include silent restriction sites, which may aid in processing of the DNA in the selected host cell. The vehicle, linker and peptide DNA sequences may be modified to include any of the foregoing sequence changes.

Methods of Making

The compounds of this invention largely may be made in transformed host cells using recombinant DNA techniques. To do so, a recombinant DNA molecule coding for the peptide is prepared. Methods of preparing such DNA molecules are well known in the art. For instance, sequences coding for the peptides could be excised from DNA using suitable restriction enzymes. Alternatively, the DNA molecule could be synthesized using chemical synthesis techniques, such as the phosphoramidate method. Also, a combination of these techniques could be used.

The invention also includes a vector capable of expressing the peptides in an appropriate host. The vector comprises the DNA molecule that codes for the peptides operatively linked to appropriate expression control sequences. Methods of effecting this operative linking, either before or after the DNA molecule is inserted into the vector, are well known. Expression control sequences include promoters, activators, enhancers, operators, ribosomal binding sites, start signals, stop signals, cap signals, polyadenylation signals, and other signals involved with the control of transcription or translation.

The resulting vector having the DNA molecule thereon is used to transform an appropriate host. This transformation may be performed using methods well known in the art.

Any of a large number of available and well-known host cells may be used in the practice of this invention. The selection of a particular host is dependent upon a number of factors recognized by the art. These include, for example, compatibility with the chosen expression vector, toxicity of the peptides encoded by the DNA molecule, rate of transformation, ease of recovery of the peptides, expression characteristics, bio-safety and costs. A balance of these factors must be struck with the understanding that not all hosts may be equally effective for the expression of a particular DNA sequence. Within these general guidelines, useful microbial hosts include bacteria (such as E. coli sp.), yeast (such as Saccharomyces sp.) and other fungi, insects, plants, mammalian (including human) cells in culture, or other hosts known in the art.

Next, the transformed host is cultured and purified. Host cells may be cultured under conventional fermentation conditions so that the desired compounds are expressed. Such fermentation conditions are well known in the art. Finally, the peptides are purified from culture by methods well known in the art.

The compounds may also be made by synthetic methods. For example, solid phase synthesis techniques may be used. Suitable techniques are well known in the art, and include those described in Merrifield (1973), Chem. Polypeptides, pp. 335–61 (Katsoyannis and Panayotis eds.); Merrifield (1963), J. Am. Chem. Soc. 85: 2149; Davis et al. (1985), Biochem. Intl. 10: 394–414; Stewart and Young (1969), Solid Phase Peptide Synthesis; U.S. Pat. No. 3,941,763; Finn et al. (1976), The Proteins (3rd ed.) 2: 105–253; and Erickson et al. (1976), The Proteins (3rd ed.) 2: 257–527. Solid phase synthesis is the preferred technique of making individual peptides since it is the most cost-effective method of making small peptides.

Compounds that contain derivatized peptides or which contain non-peptide groups may be synthesized by well-known organic chemistry techniques.

Uses of the Compounds

In General

The compounds of this invention have pharmacologic activity resulting from their ability to bind to proteins of interest as agonists, mimetics or antagonists of the native ligands of such proteins of interest. The utility of specific compounds is shown in Table 2. The activity of these compounds can be measured by assays known in the art. For the TPO-mimetic and EPO-mimetic compounds, in vivo assays are further described in the Examples section herein.

In addition to therapeutic uses, the compounds of the present invention are useful in diagnosing diseases characterized by dysfunction of their associated protein of interest. In one embodiment, a method of detecting in a biological sample a protein of interest (e.g., a receptor) that is capable of being activated comprising the steps of: (a) contacting the sample with a compound of this invention; and (b) detecting activation of the protein of interest by the compound. The biological samples include tissue specimens, intact cells, or extracts thereof. The compounds of this invention may be used as part of a diagnostic kit to detect the presence of their associated proteins of interest in a biological sample. Such kits employ the compounds of the invention having an attached label to allow for detection. The compounds are useful for identifying normal or abnormal proteins of interest. For the EPO-mimetic compounds, for example, presence of abnormal protein of interest in a biological sample may be indicative of such disorders as Diamond Blackfan anemia, where it is believed that the EPO receptor is dysfunctional.

Therapeutic Uses of EPO-mimetic Compounds

The EPO-mimetic compounds of the invention are useful for treating disorders characterized by low red blood cell levels. Included in the invention are methods of modulating the endogenous activity of an EPO receptor in a mammal, preferably methods of increasing the activity of an EPO receptor. In general, any condition treatable by erythropoietin, such as anemia, may also be treated by the EPO-mimetic compounds of the invention. These compounds are administered by an amount and route of delivery that is appropriate for the nature and severity of the condition being treated and may be ascertained by one skilled in the art. Preferably, administration is by injection, either subcutaneous, intramuscular, or intravenous.

Therapeutic Uses of TPO-mimetic Compounds

For the TPO-mimetic compounds, one can utilize such standard assays as those described in WO95/26746 entitled "Compositions and Methods for Stimulating Megakaryocyte Growth and Differentiation". In vivo assays also appear in the Examples hereinafter.

The conditions to be treated are generally those that involve an existing megakaryocyte/platelet deficiency or an expected megakaryocyte/platelet deficiency (e.g., because of planned surgery or platelet donation). Such conditions will usually be the result of a deficiency (temporary or permanent) of active Mpl ligand in vivo. The generic term for platelet deficiency is thrombocytopenia, and hence the methods and compositions of the present invention are generally available for treating thrombocytopenia in patients in need thereof.

Thrombocytopenia (platelet deficiencies) may be present for various reasons, including chemotherapy and other therapy with a variety of drugs, radiation therapy, surgery, accidental blood loss, and other specific disease conditions. Exemplary specific disease conditions that involve thrombocytopenia and may be treated in accordance with this invention are: aplastic anemia, idiopathic thrombocytopenia, metastatic tumors which result in thrombocytopenia, systemic lupus erythematosus, splenomegaly, Fanconi's syndrome, vitamin B12 deficiency, folic acid deficiency, May-Hegglin anomaly, Wiskott-Aldrich syndrome, and paroxysmal nocturnal hemoglobinuria. Also, certain treatments for AIDS result in thrombocytopenia (e.g., AZT). Certain wound healing disorders might also benefit from an increase in platelet numbers.

With regard to anticipated platelet deficiencies, e.g., due to future surgery, a compound of the present invention could be administered several days to several hours prior to the need for platelets. With regard to acute situations, e.g., accidental and massive blood loss, a compound of this invention could be administered along with blood or purified platelets.

The TPO-mimetic compounds of this invention may also be useful in stimulating certain cell types other than megakaryocytes if such cells are found to express Mpl receptor. Conditions associated with such cells that express the Mpl receptor, which are responsive to stimulation by the Mpl ligand, are also within the scope of this invention.

The TPO-mimetic compounds of this invention may be used in any situation in which production of platelets or platelet precursor cells is desired, or in which stimulation of the c-Mpl receptor is desired. Thus, for example, the compounds of this invention may be used to treat any condition in a mammal wherein there is a need of platelets, megakaryocytes, and the like. Such conditions are described in detail in the following exemplary sources: WO95/26746;

WO95/21919; WO95/18858; WO95/21920 and are incorporated herein.

The TPO-mimetic compounds of this invention may also be useful in maintaining the viability or storage life of platelets and/or megakaryocytes and related cells. Accordingly, it could be useful to include an effective amount of one or more such compounds in a composition containing such cells.

The therapeutic methods, compositions and compounds of the present invention may also be employed, alone or in combination with other cytokines, soluble Mpl receptor, hematopoietic factors, interleukins, growth factors or antibodies in the treatment of disease states characterized by other symptoms as well as platelet deficiencies. It is anticipated that the inventive compound will prove useful in treating some forms of thrombocytopenia in combination with general stimulators of hematopoiesis, such as IL-3 or GM-CSF. Other megakaryocytic stimulatory factors, i.e., meg-CSF, stem cell factor (SCF), leukemia inhibitory factor (LIF), oncostatin M (OSM), or other molecules with megakaryocyte stimulating activity may also be employed with Mpl ligand. Additional exemplary cytokines or hematopoietic factors for such co-administration include IL-1 alpha, IL-1 beta, IL-2, IL-3, IL-4, IL-5, IL-6, IL-11, colony stimulating factor-1 (CSF-1), SCF, GM-CSF, granulocyte colony stimulating factor (G-CSF), EPO, interferon-alpha (IFN-alpha), consensus interferon, IFN-beta, or IFN-gamma. It may further be useful to administer, either simultaneously or sequentially, an effective amount of a soluble mammalian Mpl receptor, which appears to have an effect of causing megakaryocytes to fragment into platelets once the megakaryocytes have reached mature form. Thus, administration of an inventive compound (to enhance the number of mature megakaryocytes) followed by administration of the soluble Mpl receptor (to inactivate the ligand and allow the mature megakaryocytes to produce platelets) is expected to be a particularly effective means of stimulating platelet production. The dosage recited above would be adjusted to compensate for such additional components in the therapeutic composition. Progress of the treated patient can be monitored by conventional methods.

In cases where the inventive compounds are added to compositions of platelets and/or megakaryocytes and related cells, the amount to be included will generally be ascertained experimentally by techniques and assays known in the art. An exemplary range of amounts is 0.1 $\mu$g–1 mg inventive compound per $10^6$ cells.

Pharmaceutical Compositions

In General

The present invention also provides methods of using pharmaceutical compositions of the inventive compounds. Such pharmaceutical compositions may be for administration for injection, or for oral, pulmonary, nasal, transdermal or other forms of administration. In general, the invention encompasses pharmaceutical compositions comprising effective amounts of a compound of the invention together with pharmaceutically acceptable diluents, preservatives, solubilizers, emulsifiers, adjuvants and/or carriers. Such compositions include diluents of various buffer content (e.g., Tris-HCl, acetate, phosphate), pH and ionic strength; additives such as detergents and solubilizing agents (e.g., Tween 80, Polysorbate 80), anti-oxidants (e.g., ascorbic acid, sodium metabisulfite), preservatives (e.g., Thimersol, benzyl alcohol) and bulking substances (e.g., lactose, mannitol); incorporation of the material into particulate preparations of polymeric compounds such as polylactic acid, polyglycolic acid, etc. or into liposomes. Hyaluronic acid may also be used, and this may have the effect of promoting sustained duration in the circulation. Such compositions may influence the physical state, stability, rate of in vivo release, and rate of in vivo clearance of the present proteins and derivatives. See, e.g., Remington's Pharmaceutical Sciences, 18th Ed. (1990, Mack Publishing Co., Easton, Pa. 18042) pages 1435–1712 which are herein incorporated by reference. The compositions may be prepared in liquid form, or may be in dried powder, such as lyophilized form. Implantable sustained release formulations are also contemplated, as are transdermal formulations.

Oral Dosage Forms

Contemplated for use herein are oral solid dosage forms, which are described generally in Chapter 89 of *Remington's Pharmaceutical Sciences* (1990), 18th Ed., Mack Publishing Co. Easton Pa. 18042, which is herein incorporated by reference. Solid dosage forms include tablets, capsules, pills, troches or lozenges, cachets or pellets. Also, liposomal or proteinoid encapsulation may be used to formulate the present compositions (as, for example, proteinoid microspheres reported in U.S. Pat. No. 4,925,673). Liposomal encapsulation may be used and the liposomes may be derivatized with various polymers (e.g., U.S. Pat. No. 5,013,556). A description of possible solid dosage forms for the therapeutic is given in Chapter 10 of Marshall, K., *Modern Pharmaceutics* (1979), edited by G. S. Banker and C. T. Rhodes, herein incorporated by reference. In general, the formulation will include the inventive compound, and inert ingredients which allow for protection against the stomach environment, and release of the biologically active material in the intestine.

Also specifically contemplated are oral dosage forms of the above inventive compounds. If necessary, the compounds may be chemically modified so that oral delivery is efficacious. Generally, the chemical modification contemplated is the attachment of at least one moiety to the compound molecule itself, where said moiety permits (a) inhibition of proteolysis; and (b) uptake into the blood stream from the stomach or intestine. Also desired is the increase in overall stability of the compound and increase in circulation time in the body. Moieties useful as covalently attached vehicles in this invention may also be used for this purpose. Examples of such moieties include: PEG, copolymers of ethylene glycol and propylene glycol, carboxymethyl cellulose, dextran, polyvinyl alcohol, polyvinyl pyrrolidone and polyproline. See, for example, Abuchowski and Davis, *Soluble Polymer-Enzyme Adducts, Enzymes as Drugs* (1981), Hocenberg and Roberts, eds., Wiley-Interscience, New York, N.Y., pp 367–83; Newmark, et al. (1982), *J. Appl. Biochem.* 4:185–9. Other polymers that could be used are poly-1,3-dioxolane and poly-1,3,6-tioxocane. Preferred for pharmaceutical usage, as indicated above, are PEG moieties.

For oral delivery dosage forms, it is also possible to use a salt of a modified aliphatic amino acid, such as sodium N-(8-[2-hydroxybenzoyl] amino) caprylate (SNAC), as a carrier to enhance absorption of the therapeutic compounds of this invention. The clinical efficacy of a heparin formulation using SNAC has been demonstrated in a Phase II trial conducted by Emisphere Technologies. See U.S. Pat. No. 5,792,451, "Oral drug delivery composition and methods".

The compounds of this invention can be included in the formulation as fine multiparticulates in the form of granules or pellets of particle size about 1 mm. The formulation of the material for capsule administration could also be as a powder, lightly compressed plugs or even as tablets. The therapeutic could be prepared by compression.

Colorants and flavoring agents may all be included. For example, the protein (or derivative) may be formulated (such as by liposome or microsphere encapsulation) and then further contained within an edible product, such as a refrigerated beverage containing colorants and flavoring agents.

One may dilute or increase the volume of the compound of the invention with an inert material. These diluents could include carbohydrates, especially mannitol, cc-lactose, anhydrous lactose, cellulose, sucrose, modified dextrans and starch. Certain inorganic salts may also be used as fillers including calcium triphosphate, magnesium carbonate and sodium chloride. Some commercially available diluents are Fast-Flo, Emdex, STA-Rx 1500, Emcompress and Avicell.

Disintegrants may be included in the formulation of the therapeutic into a solid dosage form. Materials used as disintegrants include but are not limited to starch including the commercial disintegrant based on starch, Explotab. Sodium starch glycolate, Amberlite, sodium carboxymethylcellulose, ultramylopectin, sodium alginate, gelatin, orange peel, acid carboxymethyl cellulose, natural sponge and bentonite may all be used. Another form of the disintegrants are the insoluble cationic exchange resins. Powdered gums may be used as disintegrants and as binders and these can include powdered gums such as agar, Karaya or tragacanth. Alginic acid and its sodium salt are also useful as disintegrants.

Binders may be used to hold the therapeutic agent together to form a hard tablet and include materials from natural products such as acacia, tragacanth, starch and gelatin. Others include methyl cellulose (MC), ethyl cellulose (EC) and carboxymethyl cellulose (CMC). Polyvinyl pyrrolidone (PVP) and hydroxypropylmethyl cellulose (HPMC) could both be used in alcoholic solutions to granulate the therapeutic.

An antifrictional agent may be included in the formulation of the therapeutic to prevent sticking during the formulation process. Lubricants may be used as a layer between the therapeutic and the die wall, and these can include but are not limited to; stearic acid including its magnesium and calcium salts, polytetrafluoroethylene (PTFE), liquid paraffin, vegetable oils and waxes. Soluble lubricants may also be used such as sodium lauryl sulfate, magnesium lauryl sulfate, polyethylene glycol of various molecular weights, Carbowax 4000 and 6000.

Glidants that might improve the flow properties of the drug during formulation and to aid rearrangement during compression might be added. The glidants may include starch, talc, pyrogenic silica and hydrated silicoaluminate.

To aid dissolution of the compound of this invention into the aqueous environment a surfactant might be added as a wetting agent. Surfactants may include anionic detergents such as sodium lauryl sulfate, dioctyl sodium sulfosuccinate and dioctyl sodium sulfonate. Cationic detergents might be used and could include benzalkonium chloride or benzethonium chloride. The list of potential nonionic detergents that could be included in the formulation as surfactants are lauromacrogol 400, polyoxyl 40 stearate, polyoxyethylene hydrogenated castor oil 10, 50 and 60, glycerol monostearate, polysorbate 40, 60, 65 and 80, sucrose fatty acid ester, methyl cellulose and carboxymethyl cellulose. These surfactants could be present in the formulation of the protein or derivative either alone or as a mixture in different ratios.

Additives may also be included in the formulation to enhance uptake of the compound. Additives potentially having this property are for instance the fatty acids oleic acid, linoleic acid and linolenic acid.

Controlled release formulation may be desirable. The compound of this invention could be incorporated into an inert matrix which permits release by either diffusion or leaching mechanisms e.g., gums. Slowly degenerating matrices may also be incorporated into the formulation, e.g., alginates, polysaccharides. Another form of a controlled release of the compounds of this invention is by a method based on the Oros therapeutic system (Alza Corp.), i.e., the drug is enclosed in a semipermeable membrane which allows water to enter and push drug out through a single small opening due to osmotic effects. Some enteric coatings also have a delayed release effect.

Other coatings may be used for the formulation. These include a variety of sugars which could be applied in a coating pan. The therapeutic agent could also be given in a film coated tablet and the materials used in this instance are divided into 2 groups. The first are the nonenteric materials and include methyl cellulose, ethyl cellulose, hydroxyethyl cellulose, methylhydroxy-ethyl cellulose, hydroxypropyl cellulose, hydroxypropyl-methyl cellulose, sodium carboxymethyl cellulose, providone and the polyethylene glycols. The second group consists of the enteric materials that are commonly esters of phthalic acid.

A mix of materials might be used to provide the optimum film coating. Film coating may be carried out in a pan coater or in a fluidized bed or by compression coating.

Pulmonary delivery forms. Also contemplated herein is pulmonary delivery of the present protein (or derivatives thereof). The protein (or derivative) is delivered to the lungs of a mammal while inhaling and traverses across the lung epithelial lining to the blood stream. (Other reports of this include Adjei et al., *Pharma. Res.* (1990) 7: 565–9; Adjei et al. (1990), *Internatl. J. Pharmaceutics* 63: 135–44 (leuprolide acetate); Braquet et al. (1989), *J. Cardiovasc. Pharmacol.* 13 (suppl.5): s.143–146 (endothelin-1); Hubbard et al. (1989), *Annals Int. Med.* 3: 206–12 ($\alpha$1-antitrypsin); Smith et al. (1989), *J. Clin. Invest.* 84: 1145–6 ($\alpha$1-proteinase); Oswein et al. (March 1990), "Aerosolization of Proteins", *Proc. Symp. Resp. Drug Delivery II*, Keystone, Colo. (recombinant human growth hormone); Debs et al. (1988), *J. Immunol.* 140: 3482–8 (interferon-65 and tumor necrosis factor $\alpha$) and Platz et al., U.S. Pat. No. 5,284,656 (granulocyte colony stimulating factor).

Contemplated for use in the practice of this invention are a wide range of mechanical devices designed for pulmonary delivery of therapeutic products, including but not limited to nebulizers, metered dose inhalers, and powder inhalers, all of which are familiar to those skilled in the art. Some specific examples of commercially available devices suitable for the practice of this invention are the Ultravent nebulizer, manufactured by Mallinckrodt, Inc., St. Louis, Mo.; the Acorn II nebulizer, manufactured by Marquest Medical Products, Englewood, Colo.; the Ventolin metered dose inhaler, manufactured by Glaxo Inc., Research Triangle Park, N.C.; and the Spinhaler powder inhaler, manufactured by Fisons Corp., Bedford, Mass.

All such devices require the use of formulations suitable for the dispensing of the inventive compound. Typically, each formulation is specific to the type of device employed and may involve the use of an appropriate propellant material, in addition to diluents, adjuvants and/or carriers useful in therapy.

The inventive compound should most advantageously be prepared in particulate form with an average particle size of less than 10 μm (or microns), most preferably 0.5 to 5 μm, for most effective delivery to the distal lung.

Pharmaceutically acceptable carriers include carbohydrates such as trehalose, mannitol, xylitol, sucrose, lactose, and sorbitol. Other ingredients for use in formulations may include DPPC, DOPE, DSPC and DOPC. Natural or synthetic surfactants may be used. PEG may be used (even apart from its use in derivatizing the protein or analog). Dextrans, such as cyclodextran, may be used. Bile salts and other related enhancers may be used. Cellulose and cellulose derivatives may be used. Amino acids may be used, such as use in a buffer formulation.

Also, the use of liposomes, microcapsules or microspheres, inclusion complexes, or other types of carriers is contemplated.

Formulations suitable for use with a nebulizer, either jet or ultrasonic, will typically comprise the inventive compound dissolved in water at a concentration of about 0.1 to 25 mg of biologically active protein per mL of solution. The formulation may also include a buffer and a simple sugar (e.g., for protein stabilization and regulation of osmotic pressure). The nebulizer formulation may also contain a surfactant, to reduce or prevent surface induced aggregation of the protein caused by atomization of the solution in forming the aerosol.

Formulations for use with a metered-dose inhaler device will generally comprise a finely divided powder containing the inventive compound suspended in a propellant with the aid of a surfactant. The propellant may be any conventional material employed for this purpose, such as a chlorofluorocarbon, a hydrochlorofluorocarbon, a hydrofluorocarbon, or a hydrocarbon, including trichlorofluoromethane, dichlorodifluoromethane, dichlorotetrafluoroethanol, and 1,1,1,2-tetrafluoroethane, or combinations thereof. Suitable surfactants include sorbitan trioleate and soya lecithin. Oleic acid may also be useful as a surfactant.

Formulations for dispensing from a powder inhaler device will comprise a finely divided dry powder containing the inventive compound and may also include a bulking agent, such as lactose, sorbitol, sucrose, mannitol, trehalose, or xylitol in amounts which facilitate dispersal of the powder from the device, e.g., 50 to 90% by weight of the formulation.

Nasal Delivery Forms

Nasal delivery of the inventive compound is also contemplated. Nasal delivery allows the passage of the protein to the blood stream directly after administering the therapeutic product to the nose, without the necessity for deposition of the product in the lung. Formulations for nasal delivery include those with dextran or cyclodextran. Delivery via transport across other mucous membranes is also contemplated.

Dosages

The dosage regimen involved in a method for treating the above-described conditions will be determined by the attending physician, considering various factors which modify the action of drugs, e.g. the age, condition, body weight, sex and diet of the patient, the severity of any infection, time of administration and other clinical factors. Generally, the daily regimen should be in the range of 0.1–1000 micrograms of the inventive compound per kilogram of body weight, preferably 0.1–150 micrograms per kilogram.

Specific Preferred Embodiments

The inventors have determined preferred peptide sequences for molecules having many different kinds of activity. The inventors have further determined preferred structures of these preferred peptides combined with preferred linkers and vehicles. Preferred structures for these preferred peptides listed in Table 21 below.

TABLE 21

Preferred embodiments

| Sequence/structure | SEQ ID NO: | Activity |
|---|---|---|
| $F^1$-$(G)_5$-IEGPTLRQWLAARA-$(G)_8$-IEGPTLRQWLAARA | 337 | TPO-mimetic |
| IEGPTLRQWLAARA-$(G)_8$-IEGPTLRQWLAARA-$(G)_5$-$F^1$ | 338 | TPO-mimetic |
| $F^1$-$(G)_5$-IEGPTLRQWLAARA | 1032 | TPO-mimetic |
| IEGPTLRQWLAARA-$(G)_5$-$F^1$ | 1033 | TPO-mimetic |
| $F^1$-$(G)_5$-GGTYSCHFGPLTWVCKPQGG-$(G)_4$-GGTYSCHFGPLTWVCKPQGG | 339 | EPO-mimetic |
| GGTYSCHFGPLTWVCKPQGG-$(G)_4$-GGTYSCHFGPLTWVCKPQGG-$(G)_5$-$F^1$ | 340 | EPO-mimetic |
| GGTYSCHFGPLTWVCKPQGG-$(G)_5$-$F^1$ | 1034 | EPO-mimetic |
| $F^1$-$(G)_5$-DFLPHYKNTSLGHRP | 1045 | TNF-α inhibitor |
| DFLPHYKNTSLGHRP-$(G)_5$-$F^1$ | 1046 | TNF-α inhibitor |
| $F^1$-$(G)_5$-FEWTPGYWQPYALPL | 1047 | IL-1 R antagonist |
| FEWTPGYWQPYALPL-$(G)_5$-$F^1$ | 1048 | IL-1 R antagonist |
| $F^1$-$(G)_5$-VEPNCDIHVMWEWECFERL | 1049 | VEGF-antagonist |
| VEPNCDIHVMWEWECFERL-$(G)_5$-$F^1$ | 1050 | VEGF-antagonist |
| $F^1$-$(G)_5$-CTTHWGFTLC | 1051 | MMP inhibitor |
| CTTHWGFTLC-$(G)_5$-$F^1$ | 1052 | MMP inhibitor |

"$F^1$" is an Fc domain as defined previously herein.

WORKING EXAMPLES

The compounds described above may be prepared as described below. These examples comprise preferred embodiments of the invention and are illustrative rather than limiting.

Example 1

TPO-mimetics

The following example uses peptides identified by the numbers appearing in Table A hereinafter.

Preparation of Peptide 19

Peptide 17b (12 mg) and MeO-PEG-SH 5000 (30 mg, 2 equiv.) were dissolved in 1 ml aqueous buffer (pH 8). The mixture was incubated at RT for about 30 minutes and the reaction was checked by analytical HPLC, which showed a >80% completion of the reaction. The pegylated material was isolated by preparative HPLC.

Preparation of Peptide 20

Peptide 18 (14 mg) and MeO-PEG-maleimide (25 mg) were dissolved in about 1.5 ml aqueous buffer (pH 8). The mixture was incubated at RT for about 30 minutes, at which time about 70% transformation was complete as monitored with analytical HPLC by applying an aliquot of sample to the HPLC column. The pegylated material was purified by preparative HPLC.

Bioactivity Assay

The TPO in vitro bioassay is a mitogenic assay utilizing an IL-3 dependent clone of murine 32D cells that have been transfected with human mpl receptor. This assay is described in greater detail in WO 95/26746. Cells are maintained in MEM medium containing 10% Fetal Clone II and 1 ng/ml mIL-3. Prior to sample addition, cells are prepared by rinsing twice with growth medium lacking mIL-3. An extended twelve point TPO standard curve is prepared, ranging from 33 to 39 pg/ml. Four dilutions, estimated to fall within the linear portion of the standard curve, (100 to 125 pg/ml), are prepared for each sample and run in triplicate. A volume of 100 μl of each dilution of sample or standard is added to appropriate wells of a 96 well microtiter plate containing 10,000 cells/well. After forty-four hours at 37° C. and 10% $CO_2$, MTS (a tetrazolium compound which is bioreduced by cells to a formazan) is added to each well. Approximately six hours later, the optical density is read on a plate reader at 490 nm. A dose response curve (log TPO concentration vs. O.D.- Background) is generated and linear regression analysis of points which fall in the linear portion of the standard curve is performed. Concentrations of unknown test samples are determined using the resulting linear equation and a correction for the dilution factor.

TMP Tandem Repeats with Polyglycine Linkers

Our design of sequentially linked TMP repeats was based on the assumption that a dimeric form of TMP was required for its effective interaction with c-Mpl (the TPO receptor) and that depending on how they were wound up against each other in the receptor context, the two TMP molecules could be tethered together in the C- to N-terminus configuration in a way that would not perturb the global dimeric conformation. Clearly, the success of the design of tandem linked repeats depends on proper selection of the length and composition of the linker that joins the C- and N-termini of the two sequentially aligned TMP monomers. Since no structural information of the TMP bound to c-Mpl was available, a series of repeated peptides with linkers composed of 0 to 10 and 14 glycine residues (Table A) were synthesized. Glycine was chosen because of its simplicity and flexibility, based on the rationale that a flexible polyglycine peptide chain might allow for the free folding of the two tethered TMP repeats into the required conformation, while other amino acid sequences may adopt undesired secondary structures whose rigidity might disrupt the correct packing of the repeated peptide in the receptor context.

The resulting peptides are readily accessible by conventional solid phase peptide synthesis methods (Merrifield (1963), *J. Amer. Chem. Soc*. 85: 2149) with either Fmoc or t-Boc chemistry. Unlike the synthesis of the C-terminally linked parallel dimer which required the use of an orthogonally protected lysine residue as the initial branch point to build the two peptide chains in a pseudosymmetrical way (Cwirla et al. (1997), *Science* 276: 1696–9), the synthesis of these tandem repeats was a straightforward, stepwise assembly of the continuous peptide chains from the C- to N-terminus. Since dimerization of TMP had a more dramatic effect on the proliferative activity than binding affinity as shown for the C-terminal dimer (Cwirla et al. (1997)), the synthetic peptides were tested directly for biological activity in a TPO-dependent cell-proliferation assay using an IL-3 dependent clone of murine 32D cells transfected with the full-length c-Mpl (Palacios et al., Cell 41:727 (1985)). As the test results showed, all the polyglycine linked tandem repeats demonstrated >1000 fold increases in potency as compared to the monomer, and were even more potent than the C-terminal dimer in this cell proliferation assay. The absolute activity of the C-terminal dimer in our assay was lower than that of the native TPO protein, which is different from the previously reported findings in which the C-terminal dimer was found to be as active as the natural ligand (Cwirla et al. (1997)). This might be due to differences in the conditions used in the two assays. Nevertheless, the difference in activity between tandem (C terminal of first monomer linked to N terminal of second monomer) and C-terminal (C terminal of first monomer linked to C terminal of second monomer; also referred to as parallel) dimers in the same assay clearly demonstrated the superiority of tandem repeat strategy over parallel peptide dimerization. It is interesting to note that a wide range of length is tolerated by the linker. The optimal linker between tandem peptides with the selected TMP monomers apparently is composed of 8 glycines.

Other Tandem Repeats

Subsequent to this first series of TMP tandem repeats, several other molecules were designed either with different linkers or containing modifications within the monomer itself. The first of these molecules, peptide 13, has a linker composed of GPNG, a sequence known to have a high propensity to form a β-turn-type secondary structure. Although still about 100-fold more potent than the monomer, this peptide was found to be >10-fold less active than the equivalent GGGG-linked analog. Thus, introduction of a relatively rigid β-turn at the linker region seemed to have caused a slight distortion of the optimal agonist conformation in this short linker form.

The Trp9 in the TMP sequence is a highly conserved residue among the active peptides isolated from random peptide libraries. There is also a highly conserved Trp in the consensus sequences of EPO mimetic peptides and this Trp residue was found to be involved in the formation of a hydrophobic core between the two EMPs and contributed to hydrophobic interactions with the EPO receptor. Livnah et al. (1996), *Science* 273: 464–15 71). By analogy, the Trp9 residue in TMP might have a similar function in dimerization of the peptide ligand, and as an attempt to modulate and estimate the effects of noncovalent hydrophobic forces exerted by the two indole rings, several analogs were made resulting from mutations at the Trp. So in peptide 14, the Trp residue was replaced in each of the two TMP monomers with a Cys, and an intramolecular disulfide bond was formed between the two cysteines by oxidation which was envisioned to mimic the hydrophobic interactions between the two Trp residues in peptide dimerization. Peptide 15 is the reduced form of peptide 14. In peptide 16, the two Trp residues were replaced by Ala. As the assay data show, all three analogs were inactive. These data further demonstrated that Trp is critical for the activity of the TPO mimetic peptide, not just for dimer formation.

The next two peptides (peptide 17a, and 18) each contain in their 8-amino acid linker a Lys or Cys residue. These two compounds are precursors to the two PEGylated peptides (peptide 19 and 20) in which the side chain of the Lys or Cys is modified by a PEG moiety. A PEG moiety was introduced at the middle of a relatively long linker, so that the large PEG component (5 kDa) is far enough away from the critical binding sites in the peptide molecule. PEG is a known biocompatible polymer which is increasingly used as a covalent modifier to improve the pharmacokinetic profiles of peptide- and protein-based therapeutics.

A modular, solution-based method was devised for convenient PEGylation of synthetic or recombinant peptides. The method is based on the now well established chemoselective ligation strategy which utilizes the specific reaction between a pair of mutually reactive functionalities. So, for pegylated peptide 19, the lysine side chain was preactivated with a bromoacetyl group to give peptide 17b to accommodate reaction with a thiol-derivatized PEG. To do that, an orthogonal protecting group, Dde, was employed for the protection of the lysine E-amine. Once the whole peptide chain was assembled, the N-terminal amine was reprotected with t-Boc. Dde was then removed to allow for the bromoacetylation. This strategy gave a high quality crude peptide which was easily purified using conventional reverse phase HPLC. Ligation of the peptide with the thiol-20 modified PEG took place in aqueous buffer at pH 8 and the reaction completed within 30 minutes. MALDI-MS analysis of the purified, pegylated material revealed a characteristic, bell-shaped spectrum with an increment of 44 Da between the adjacent peaks. For PEG-peptide 20, a cysteine residue was placed in the linker region and its side chain thiol group would serve as an attachment site for a maleimide-containing PEG. Similar conditions were used for the pegylation of this peptide. As the assay data revealed, these two pegylated peptides had even higher in vitro bioactivity as compared to their unpegylated counterparts.

Peptide 21 has in its 8-amino acid linker a potential glycosylation motif, NGS. Since our exemplary tandem repeats are made up of natural amino acids linked by peptide bonds, expression of such a molecule in an appropriate eukaryotic cell system should produce a glycopeptide with the carbohydrate moiety added on the side chain carboxyamide of Asn. Glycosylation is a common post-translational modification process which can have many positive impacts on the biological activity of a given protein by increasing its aqueous solubility and in vivo stability. As the assay data show, incorporation of this glycosylation motif into the linker maintained high bioactivity. The synthetic precursor of the potential glycopeptide had in effect an activity comparable to that of the $-(G)_8$-linked analog. Once glycosylated, this peptide is expected to have the same order of activity as the pegylated peptides, because of the similar chemophysical properties exhibited by a PEG and a carbohydrate moiety.

The last peptide is a dimer of a tandem repeat. It was prepared by oxidizing peptide 18, which formed an intermolecular disulfide bond between the two cysteine residues located at the linker. This peptide was designed to address the possibility that TMP was active as a tetramer. The assay data showed that this peptide was not more active than an average tandem repeat on an adjusted molar basis, which indirectly supports the idea that the active form of TMP is indeed a dimer, otherwise dimerization of a tandem repeat would have a further impact on the bioactivity.

In order to confirm the in vitro data in animals, one pegylated TMP tandem repeat (compound 20 in Table A) was delivered subcutaneously to normal mice via osmotic pumps. Time and dose-dependent increases were seen in platelet numbers for the duration of treatment. Peak platelet levels over 4-fold baseline were seen on day 8. A dose of 10 µg/kg/day of the pegylated TMP repeat produced a similar response to rHuMGDF (non-pegylated) at 100 µg/kg/day delivered by the same route.

TABLE A

TPO-mimetic Peptides

| Peptide No. | Compound | SEQ ID NO: | Relative Potency |
|---|---|---|---|
|  | TPO |  | ++++ |
|  | TMP monomer | 13 | + |
|  | TMP C—C dimer |  | +++− |
| TMP-(G)$_n$-TMP: |  |  |  |
| 1 | n = 0 | 341 | ++++− |
| 2 | n = 1 | 342 | ++++ |
| 3 | n = 2 | 343 | ++++ |
| 4 | n = 3 | 344 | ++++ |
| 5 | n = 4 | 345 | ++++ |
| 6 | n = 5 | 346 | ++++ |
| 7 | n = 6 | 347 | ++++ |
| 8 | n = 7 | 348 | ++++ |
| 9 | n = 8 | 349 | ++++− |
| 10 | n = 9 | 350 | ++++ |
| 11 | n = 10 | 351 | ++++ |
| 12 | n = 14 | 352 | ++++ |
| 13 | TMP-GPNG-TMP | 353 | +++ |

TABLE A-continued

TPO-mimetic Peptides

| Peptide No. | Compound | SEQ ID NO: | Relative Potency |
|---|---|---|---|
| 14 | IEGPTLRQCLAARA-GGGGGGGG-IEGPTLRQCLAARA<br>       |_____|<br>(cyclic) | 354 | – |
| 15 | IEGPTLRQCLAARA-GGGGGGGG-IEGPTLRQCLAARA (linear) | 355 | – |
| 16 | IEGPTLRQALAARA-GGGGGGGG-IEGPTLRQALAARA | 356 | – |
| 17a | TMP-GGGKGGGG-TMP | 357 | ++++ |
| 17b | TMP-GGGK(BrAc)GGGG-TMP | 358 | ND |
| 18 | TMP-GGGCGGGG-TMP | 359 | ++++ |
| 19 | TMP-GGGK(PEG)GGGG-TMP | 360 | +++++ |
| 20 | TMP-GGGC(PEG)GGGG-TMP | 361 | +++++ |
| 21 | TMP-GGGN*GSGG-TMP | 362 | ++++ |
| 22 | TMP-GGGCGGGG-TMP<br>       |<br>TMP-GGGCGGGG-TMP | 363<br><br>363 | ++++ |

Discussion

It is well accepted that MGDF acts in a way similar to hGH, i.e., one molecule of the protein ligand binds two molecules of the receptor for its activation. Wells et al. (1996), *Ann. Rev. Biochem.* 65: 609–34. Now, this interaction is mimicked by the action of a much smaller peptide, TMP. However, the present studies suggest that this mimicry requires the concerted action of two TMP molecules, as covalent dimerization of TMP in either a C-C parallel or C-N sequential fashion increased the in vitro biological potency of the original monomer by a factor of greater than $10^3$. The relatively low biopotency of the monomer is probably due to inefficient formation of the noncovalent dimer. A preformed covalent repeat has the ability to eliminate the entropy barrier for the formation of a noncovalent dimer which is exclusively driven by weak, noncovalent interactions between two molecules of the small, 14-residue peptide.

It is intriguing that this tandem repeat approach had a similar effect on enhancing bioactivity as the reported C-C dimerization is intriguing. These two strategies brought about two very different molecular configurations. The C-C dimer is a quasi-symmetrical molecule, while the tandem repeats have no such symmetry in their linear structures. Despite this difference in their primary structures, these two types of molecules appeared able to fold effectively into a similar biologically active conformation and cause the dimerization and activation of c-Mpl. These experimental observations provide a number of insights into how the two TMP molecules may interact with one another in binding to c-Mpl. First, the two C-termini of the two bound TMP molecules must be in relatively close proximity with each other, as suggested by data on the C-terminal dimer. Second, the respective N- and C-termini of the two TMP molecules in the receptor complex must also be very closely aligned with each other, such that they can be directly tethered together with a single peptide bond to realize the near maximum activity-enhancing effect brought about by the tandem repeat strategy. Insertion of one or more (up to 14) glycine residues at the junction did not increase (or decrease) significantly the activity any further. This may be due to the fact that a flexible polyglycine peptide chain is able to loop out easily from the junction without causing any significant changes in the overall conformation. This flexibility seems to provide the freedom of orientation for the TMP peptide chains to fold into the required conformation in interacting with the receptor and validate it as a site of modification. Indirect evidence supporting this came from the study on peptide 13, in which a much more rigid b-turn-forming sequence as the linker apparently forced a deviation of the backbone alignment around the linker which might have resulted in a slight distortion of the optimal conformation, thus resulting in a moderate (10-fold) decrease in activity as compared with the analogous compound with a 4-Gly linker. Third, Trp9 in TMP plays a similar role as Trp13 in EMP, which is involved not only in peptide:peptide interaction for the formation of dimers but also is important for contributing hydrophobic forces in peptide:receptor interaction. Results obtained with the W to C mutant analog, peptide 14, suggest that a covalent disulfide linkage is not sufficient to approximate the hydrophobic interactions provided by the Trp pair and that, being a short linkage, it might bring the two TMP monomers too close, therefore perturbing the overall conformation of the optimal dimeric structure.

An analysis of the possible secondary structure of the TMP peptide can provide further understanding on the interaction between TMP and c-Mpl. This can be facilitated by making reference to the reported structure of the EPO mimetic peptide. Livnah et al. (1996), *Science* 273:464–75 The receptor-bound EMP has a b-hairpin structure with a b-turn formed by the highly consensus Gly-Pro-Leu-Thr at the center of its sequence. Instead of GPLT, TMP has a highly selected GPTL sequence which is likely to form a similar turn. However, this turn-like motif is located near the N-terminal part in TMP. Secondary structure prediction using Chau-Fasman method suggests that the C-terminal half of the peptide has a tendency to adopt a helical conformation. Together with the highly conserved Trp at position 9, this C-terminal helix may contribute to the stabilization of the dimeric structure. It is interesting to note that most of our tandem repeats are more potent than the C-terminal parallel dimer. Tandem repeats seem to give the molecule a better fit conformation than does the C-C parallel dimerization. The seemingly asymmetric feature of a tandem repeat might have brought it closer to the natural ligand which, as an asymmetric molecule, uses two different sites to bind two identical receptor molecules.

Introduction of a PEG moiety was envisaged to enhance the in vivo activity of the modified peptide by providing it a protection against proteolytic degradation and by slowing down its clearance through renal filtration. It was unexpected that pegylation could further increase the in vitro bioactivity of a tandem repeated TMP peptide in the cell-based proliferation assay.

Example 2

Fc-TMP Fusions

TMPs (and EMPs as described in Example 3) were expressed in either monomeric or dimeric form as either N-terminal or C-terminal fusions to the Fc region of human IgG1. In all cases, the expression construct utilized the luxPR promoter promoter in the plasmid expression vector pAMG21.

Fc-TMP

A DNA sequence coding for the Fc region of human IgG1 fused in-frame to a monomer of the TPO-mimetic peptide was constructed using standard PCR technology. Templates for PCR reactions were the pFc-A3 vector and a synthetic TMP gene. The synthetic gene was constructed from the 3 overlapping oligonucleotides (SEQ ID NOS: 364, 365, and 366, respectively) shown below:

The oligonucleotides 1830-51 and 1842-98 contain an overlap of 24 nucleotides, allowing the two genes to be fused together in the correct reading frame by combining the above PCR products in a third reaction using the outside primers, 1216-52 and 1842-97.

The final PCR gene product (the full length fusion gene) was digested with restriction endonucleases XbaI and BamHI, and then ligated into the vector pAMG21 and transformed into competent E. coli strain 2596 cells as described for EMP-Fc herein. Clones were screened for the ability to produce the recombinant protein product and to possess the gene fusion having the correct nucleotide sequence. A single such clone was selected and designated Amgen strain #3728.

The nucleotide and amino acid sequences (SEQ ID NOS: 5 and 6) of the fusion protein are shown in FIG. 7.

Fc-TMP-TMP

A DNA sequence coding for the Fc region of human IgG1 fused in-frame to a dimer of the TPO-mimetic peptide was constructed using standard PCR technology. Templates for PCR reactions were the pFc-A3 vector and a synthetic TMP-TMP gene. The synthetic gene was constructed from the 4 overlapping oligonucleotides (SEQ ID NOS: 371 to 374, respectively) shown below:

```
1842-97  AAA AAA GGA TCC TCG AGA TTA AGC ACG AGC AGC CAG CCA
         CTG ACG CAG AGT CGG ACC 1842-98  AAA GGT GGA GGT GGT GGT ATC GAA GGT CCG ACT CTG CGT 1842-99  CAG TGG CTG GCT GCT CGT GCT TAA TCT CGA GGA TCC TTT
         TTT
```

These oligonucleotides were annealed to form the duplex encoding an amino acid sequence (SEQ ID NOS: 367 and 368, respectively) shown below:

```
     AAAGGTGGAGGTGGTGGTATCGAAGGTCCGACTCTGCGTCAGTGGCTGGCTGCTCGTGCT
  1  ---------+---------+---------+---------+---------+---------+60
                                  CCAGGCTGAGACGCAGTCACCGACCGACGAGCACGA
a    K  G  G  G  G  I  E  G  P  T  L  R  Q  W  L  A  A  R  A   -

TAATCTCGAGGATCCTTTTTT
 61  ---------+---------+- 81
     ATTAGAGCTCCTAGGAAAAAA
a    *
```

This duplex was amplified in a PCR reaction using 1842-98 and 1842-97 as the sense and antisense primers.

The Fc portion of the molecule was generated in a PCR reaction with pFc-A3 using the primers shown below (SEQ ID NOS: 369 and 370):

```
1216-52  AAC ATA AGT ACC TGT AGG ATC G 1830-51  TTCGATACCA CCACCTCCAC CTTTACCCGG AGACAGGGAG AGGCTCTTCTGC
```

```
1830-52  AAA GGT GGA GGT GGT GGT ATC GAA GGT CCG
         ACT CTG CGT CAG TGG CTG GCT GCT CGT GCT 1830-53  ACC TCC ACC ACC AGC ACG AGC AGC CAG
         CCA CTG ACG CAG AGT CGG ACC 1830-54  GGT GGT GGA GGT GGC GGC GGA GGT ATT GAG GGC CCA ACC
         CTT CGC CAA TGG CTT GCA GCA CGC GCA 1830-55  AAA AAA AGG ATC CTC GAG ATT ATG CGC GTG CTG CAA GCC
         ATT GGC GAA GGG TTG GGC CCT CAA TAC CTC CGC CGC C
```

The 4 oligonucleotides were annealed to form the duplex encoding an amino acid sequence (SEQ ID NOS: 375 and 376, respectively) shown below:

```
         AAAGGTGGAGGTGGTGGTATCGAAGGTCCGACTCTGCGTCAGTGGCTGGCTGCTCGTGCT
      1  ---------+---------+---------+---------+---------+---------+  60
                                                                      CCAGGCTGAGACGCAGTCACCGACCGACGAGCACGA
  a      K   G   G   G   G   I   E   G   P   T   L   R   Q   W   L   A   A   R   A   -

GGTGGTGGAGGTGGCGGCGGAGGTATTGAGGGCCCAACCCTTCGCCAATGGCTTGCAGCA
     61  ---------+---------+---------+---------+---------+---------+120
         CCACCACCTCCACCGCCGCCTCCATAACTCCCGGGTTGGGAAGCGGTTACCGAACGTCGT
  a      G   G   G   G   G   G   I   E   G   P   T   L   R   Q   W   L   A   A   -

CGCGCA
    121  --------------------------148
         GCGCGTATTAGAGCTCCTAGGAAAAAAA
  a      R   A   *-
```

This duplex was amplified in a PCR reaction using 1830-52 and 1830-55 as the sense and antisense primers.

The Fc portion of the molecule was generated in a PCR reaction with pFc-A3 using the primers 1216-52 and 1830-51 as described above for Fc-TMP. The full length fusion gene was obtained from a third PCR reaction using the outside primers 1216-52 and 1830-55.

The final PCR gene product (the full length fusion gene) was digested with restriction endonucleases XbaI and BamHI, and then ligated into the vector pAMG21 and transformed into competent E. coli strain 2596 cells as described in example 1. Clones were screened for the ability to produce the recombinant protein product and to possess the gene fusion having the correct nucleotide sequence. A single such clone was selected and designated Amgen strain #3727.

Figure 8:
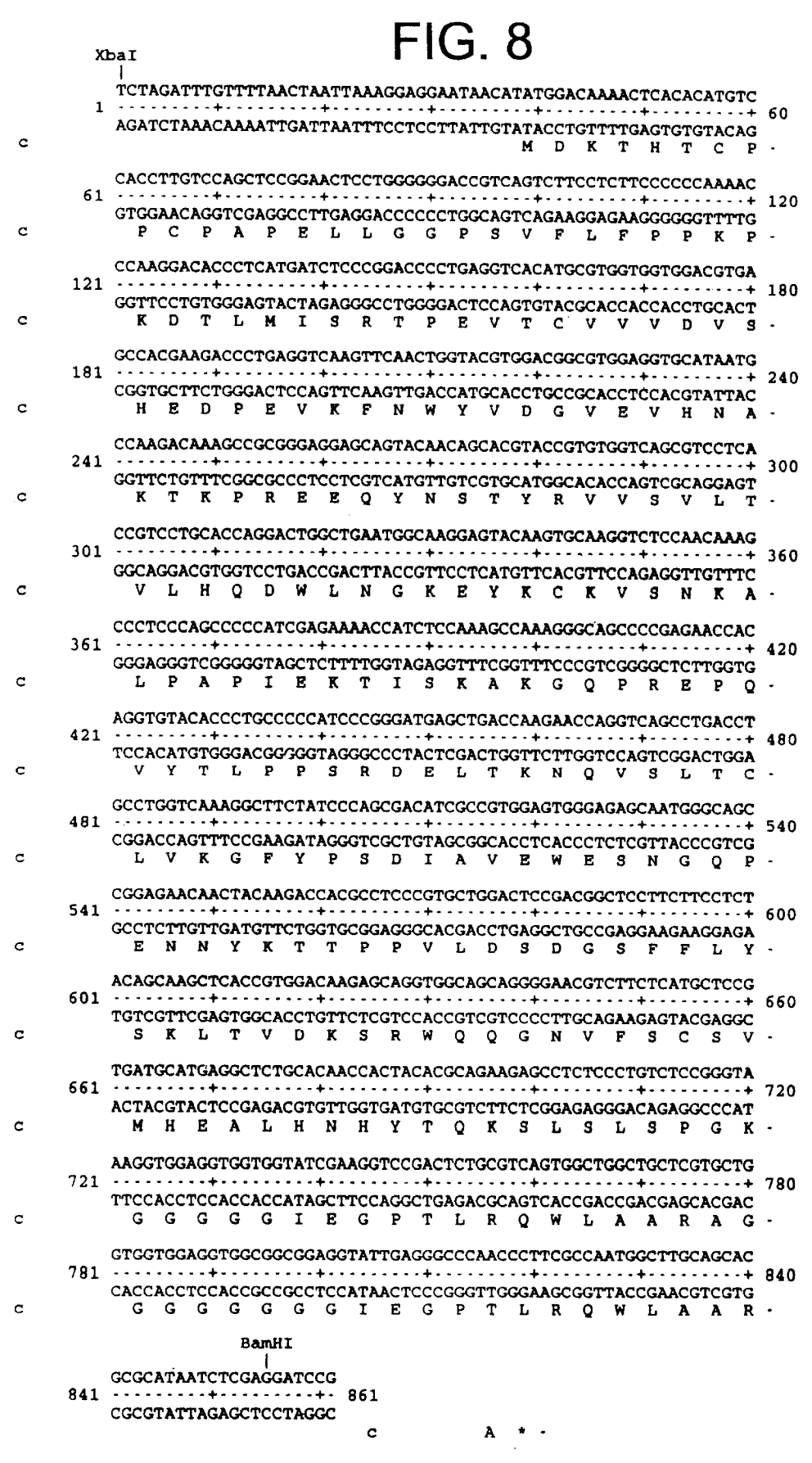

The nucleotide and amino acid sequences (SEQ ID NOS: 7 and 8) of the fusion protein are shown in FIG. 8.

TMP-TMP-Fc. A DNA sequence coding for a tandem repeat of the TPO-mimetic peptide fused in-frame to the Fc region of human IgG1 was constructed using standard PCR technology. Templates for PCR reactions were the EMP-Fc plasmid from strain #3688 (see Example 3) and a synthetic gene encoding the TMP dimer. The synthetic gene for the tandem repeat was constructed from the 7 overlapping oligonucleotides shown below (SEQ ID NOS: 377 to 383, respectively):

```
1885-52  TTT TTT CAT ATG ATC GAA GGT CCG ACT CTG CGT CAG TGG 1885-53  AGC ACG AGC AGC CAG CCA CTG ACG CAG AGT CGG ACC TTC
         GAT CAT ATG 1885-54  CTG GCT GCT CGT GCT GGT GGA GGC GGT GGG GAC AAA ACT
         CAC ACA 1885-55  CTG GCT GCT CGT GCT GGC GGT GGT GGC GGA GGG GGT GGC
         ATT GAG GGC CCA 1885-56  AAG CCA TTG GCG AAG GGT TGG GCC CTC AAT GCC ACC CCC
         TCC GCC ACC ACC GCC 1885-57  ACC CTT CGC CAA TGG CTT GCA GCA CGC GCA GGG GGA GGC
         GGT GGG GAC AAA ACT 1885-58  CCC ACC GCC TCC CCC TGC GCG TGC TGC
```

These oligonucleotides were annealed to form the duplex shown encoding an amino acid sequence shown below (SEQ ID NOS 384 and 385):

```
         TTTTTTCATATGATCGAAGGTCCGACTCTGCGTCAGTGGCTGGCTGCTCGTGCTGGCGGT
      1  ---------+---------+---------+---------+---------+---------+60
                GTATACTAGCTTCCAGGCTGAGACGCAGTCACCGACCGACGAGCACGACCGCCA
                   M  I  E  G  P  T  L  R  Q  W  L  A  A  R  A  G  G   -

GGTGGCGGAGGGGGTGGCATTGAGGGCCCAACCCTTCGCCAATGGCTGGCTGCTCGTGCT
     61  ---------+---------+---------+---------+---------+---------+120
         CCACCGCCTCCCCCACCGTAACTCCCGGGTTGGGAAGCGGTTACCGAACGTCGTGCGCGT
a          G  G  G  G  G  I  E  G  P  T  L  R  Q  W  L  A  A  R  A   -

GGTGGAGGCGGTGGGGACAAAACTCTGGCTGCTCGTGCTGGTGGAGGCGGTGGGGACAAA
    121  ---------+---------+---------+---------+---------+---------+180
         CCCCCTCCGCCACCC
a          G  G  G  G  G  D  K  T  L  A  A  R  A  G  G  G  G  D  K   -

ACTCACACA
    181  --------- 189
a          T  H  T   -
```

This duplex was amplified in a PCR reaction using 1885-52 and 1885-58 as the sense and antisense primers.

The Fc portion of the molecule was generated in a PCR reaction with DNA from the EMP-Fc fusion strain #3688 (see Example 3) using the primers 1885-54 and 1200-54. The full length fusion gene was obtained from a third PCR reaction using the outside primers 1885-52 and 1200-54.

The final PCR gene product (the full length fusion gene) was digested with restriction endonucleases XbaI and BamHI, and then ligated into the vector pAMG21 and transformed into competent E. coli strain 2596 cells as described for Fc-EMP herein. Clones were screened for the ability to produce the recombinant protein product and to possess the gene fusion having the correct nucleotide sequence. A single such clone was selected and designated Amgen strain #3798.

The nucelotide and amino acid sequences (SEQ ID NOS: 9 and 10) of the fusion protein are shown in FIG. 9.

TMP-Fc

A DNA sequence coding for a monomer of the TPO-mimetic peptide fused in-frame to the Fc region of human IgG1 was obtained fortuitously in the ligation in TMP-TMP-Fc, presumably due to the ability of primer 1885-54 to anneal to 1885-53 as well as to 1885-58. A single clone having the correct nucleotide sequence for the TMP-Fc construct was selected and designated Amgen strain #3788.

The nucleotide and amino acid sequences (SEQ ID NOS: 11 and 12) of the fusion protein are shown in FIG. 10.

Expression in E. coli

Cultures of each of the pAMG21-Fc-fusion constructs in E. coli GM221 were grown at 37° C. in Luria Broth medium containing 50 mg/ml kanamycin. Induction of gene product expression from the luxPR promoter was achieved following the addition of the synthetic autoinducer N-(3-oxohexanoyl)-DL-homoserine lactone to the culture media to a final concentration of 20 ng/ml. Cultures were incubated at 37° C. for a further 3 hours. After 3 hours, the bacterial cultures were examined by microscopy for the presence of inclusion bodies and were then collected by centrifugation. Refractile inclusion bodies were observed in induced cultures indicating that the Fc-fusions were most likely produced in the insoluble fraction in E. coli. Cell pellets were lysed directly by resuspension in Laemmli sample buffer containing 10% b-mercaptoethanol and were analyzed by SDS-PAGE. In each case, an intense coomassie-stained band of the appropriate molecular weight was observed on an SDS-PAGE gel.

pAMG21

The expression plasmid pAMG21 can be derived from the Amgen expression vector pCFM1656 (ATCC #69576) which in turn be derived from the Amgen expression vector system described in U.S. Pat. No. 4,710,473. The pCFM1656 plasmid can be derived from the described pCFM836 plasmid (U.S. Pat. No. 4,710,473) by:

(a) destroying the two endogenous NdeI restriction sites by end filling with T4 polymerase enzyme followed by blunt end ligation;

(b) replacing the DNA sequence between the unique AatII and ClaI restriction sites containing the synthetic $P_L$ promoter with a similar fragment obtained from pCFM636 (U.S. Pat. No. 4,710,473) containing the PL promoter (see SEQ ID NO: 386 below); and (c) substituting the small DNA sequence between the unique ClaI and KpnI restriction sites with the oligonucleotide having the sequence of SEQ ID NO: 388.

```
SEQ ID NO: 386:

AatII
5' CTAATTCCGCTCTCACCTACCAAACAATGCCCCCCTGCAAAAATAAATTCATAT-
3' TGCAGATTAAGGCGAGAGTGGATGGTTTGTTACGGGGGGACGTTTTTTATTTAAGTATA-

AAAAAACATACAGATAACCATCTGCGGTGATAAATTATCTCTGGCGGTGTTGACATAAA-
   TTTTTTGTATGTCTATTGGTAGACGCCACTATTTAATAGAGACCGCCACAACTGTATTT-

TACCACTGGCGGTGATACTGAGCACAT    3'
```

-continued
```
ATGGTGACCGCCACTATGACTCGTGTAGC 5'
             ClaI
```

SEQ ID NO: 387:

```
5' CGATTTGATTCTAGAAGGAGGAATAACATATGGTTAACGCGTTGGAATTCGGTAC 3'

3'    TAAACTAAGATCTTCCTCCTTATTGTATACCAATTGCGCAACCTTAAGC     5'
   ClaI                                              KpnI
```

The expression plasmid pAMG21 can then be derived from pCFM1656 by making a series of site-directed base changes by PCR overlapping oligo mutagenesis and DNA sequence substitutions. Starting with the BglII site (plasmid bp #180) immediately 5' to the plasmid replication promoter PcopB and proceeding toward the plasmid replication genes, the base pair changes are as shown in Table B below.

TABLE B

Base pair changes resulting in pAMG21

| pAMG21 bp # | bp in pCFM1656 | bp changed to in pAMG21 |
| --- | --- | --- |
| # 204 | T/A | C/G |
| # 428 | A/T | G/C |
| # 509 | G/C | A/T |
| # 617 | — | insert two G/C bp |
| # 679 | G/C | T/A |
| # 980 | T/A | C/G |
| # 994 | G/C | A/T |
| # 1004 | A/T | C/G |
| # 1007 | C/G | T/A |
| # 1028 | A/T | T/A |
| # 1047 | C/G | T/A |
| # 1178 | G/C | T/A |
| # 1466 | G/C | T/A |
| # 2028 | G/C | bp deletion |
| # 2187 | C/G | T/A |
| # 2480 | A/T | T/A |
| # 2499–2502 | AGTG TCAC | GTCA CAGT |
| # 2642 | TCCGAGC AGGCTCG | 7 bp deletion |
| # 3435 | G/C | A/T |
| # 3446 | G/C | A/T |
| # 3643 | A/T | T/A |

The DNA sequence between the unique AatII (position #4364 in pCFM1656) and SacII (position #4585 in pCFM1656) restriction sites is substituted with the DNA sequence (SEQ ID NO: 23) shown in FIGS. 17A and 17B. During the ligation of the sticky ends of this substitution DNA sequence, the outside AatII and SacII sites are destroyed. There are unique AatII and SacII sites in the substituted DNA.

GM221 (Amgen #2596). The Amgen host strain #2596 is an *E. coli* K-12 strain derived from Amgen strain #393. It has been modified to contain both the temperature sensitive lambda repressor cI857s7 in the early ebg region and the lacI$^Q$ repressor in the late ebg region (68 minutes). The presence of these two repressor genes allows the use of this host with a variety of expression systems, however both of these repressors are irrelevant to the expression from luxP$_R$. The untransformed host has no antibiotic resistances.

The ribosome binding site of the cI857s7 gene has been modified to include an enhanced RBS. It has been inserted into the ebg operon between nucleotide position 1170 and 1411 as numbered in Genbank accession number M64441Gb_Ba with deletion of the intervening e sequence. The sequence of the insert is shown below with lower case letters representing the ebg sequences flanking the insert shown below (SEQ ID NO: 388):

```
ttattttcgtGCGGCCGCACCATTATCACCGCCAGAGGTAAACTAGTCAACACGCACGGTGTTAGATATTTAT

CCCTTGCGGTGATAGATTGAGCACATCGATTTGATTCTAGAAGGAGGGATAATATATGAGCACAAAAAAGAAA

CCATTAACACAAGAGCAGCTTGAGGACGCACGTCGCCTTAAAGCAATTTATGAAAAAAAGAAAAATGAACTTG

GCTTATCCCAGGAATCTGTCGCAGACAAGATGGGGATGGGGCAGTCAGGCGTTGGTGCTTTATTTAATGGCAT

CAATGCATTAAATGCTTATAACGCCGCATTGCTTACAAAAATTCTCAAAGTTAGCGTTGAAGAATTTAGCCCT

TCAATCGCCAGAGAATCTACGAGATGTATGAAGCGGTTAGTATGCAGCCGTCACTTAGAAGTGAGTATGAGTA

CCCTGTTTTTTCTCATGTTCAGGCAGGGATGTTCTCACCTAAGCTTAGAACCTTTACCAAAGGTGATGCGGAG

AGATGGGTAAGCACAACCAAAAAAGCCAGTGATTCTGCATTCTGGCTTGAGGTTGAAGGTAATTCCATGACCG

CACCAACAGGCTCCAAGCCAAGCTTTCCTGACGGAATGTTAATTCTCGTTGACCCTGAGCAGGCTGTTGAGCC

AGGTGATTTCTGCATAGCCAGACTTGGGGGTGATGAGTTTACCTTCAAGAAACTGATCAGGGATAGCGGTCAG
```

-continued

```
GTGTTTTTACAACCACTAAACCCACAGTACCCAATGATCCCATGCAATGAGAGTTGTTCCGTTGTGGGGAAAG

TTATCGCTAGTCAGTGGCCTGAAGAGACGTTTGGCTGATAGACTAGTGGATCCACTAGTgtttctgccc
```

The construct was delivered to the chromosome using a recombinant phage called MMebg-cI857s7enhanced RBS #4 into F'tet/393. After recombination and resolution only the chromosomal insert described above remains in the cell. It was renamed F'tet/GM101. F'tet/GM101 was then modified by the delivery of a lacI$^Q$ construct into the ebg operon between nucleotide position 2493 and 2937 as numbered in the Genbank accession number M64441Gb_Ba with the deletion of the intervening eb sequence. The sequence of the insert is shown below with the lower case letters representing the ebg sequences flanking the insert (SEQ ID NO: 389) shown below:

presence of inclusion bodies and were then collected by centrifugation. Refractile inclusion bodies were observed in induced cultures indicating that the Fc-TMP-TMP was most likely produced in the insoluble fraction in *E. coli*. Cell pellets were lysed directly by resuspension in Laemmli sample buffer containing 10% .-mercaptoethanol and were analyzed by SDS-PAGE. An intense Coomassie stained band of approximately 30 kDa was observed on an SDS-PAGE gel. The expected gene product would be 269 amino acids in length and have an expected molecular weight of about 29.5 kDa. Fermentation was also carried out under standard batch conditions at the 10 L scale, resulting in

```
ggcggaaaccGACGTCCATCGAATGGTGCAAAACCTTTCGCGGTATGGCATGATAGCGCCCGGAAGAGAGTCA

ATTCAGGGTGGTGAATGTGAAACCAGTAACGTTATACGATGTCGCAGAGTATGCCGGTGTCTCTTATCAGACC

GTTTCCCGCGTGGTGAACCAGGCCAGCCACGTTTCTGCGAAAACGCGGGAAAAAGTCGAAGCGGCGATGGCGG

AGCTGAATTACATTCCCAACCGCGTGGCACAACAACTGGCGGGCAAACAGTCGCTCCTGATTGGCGTTGCCAC

CTCCAGTCTGGCCCTGCACGCGCCGTCGCAAATTGTCGCGGCGATTAAATCTCGCGCCGATCAACTGGGTGCC

AGCGTGGTGGTGTCGATGGTAGAACGAAGCGGCGTCGAAGCCTGTAAAGCGGCGGTGCACAATCTTCTCGCGC

AACGCGTCAGTGGGCTGATCATTAACTATCCGCTGGATGACCAGGATGCCATTGCTGTGGAAGCTGCCTGCAC

TAATGTTCCGGCGTTATTTCTTGATGTCTCTGACCAGACACCCATCAACAGTATTATTTTCTCCCATGAAGAC

GGTACGCGACTGGGCGTGGAGCATCTGGTCGCATTGGGTCACCAGCAAATCGCGCTGTTAGCGGGCCCATTAA

GTTCTGTCTCGGCGCGTCTGCGTCTGGCTGGCTGGCATAAATATCTCACTCGCAATCAAATTCAGCCGATAGC

GGAACGGGAAGGCGACTGGAGTGCCATGTCCGGTTTTCAACAAACCATGCAAATGCTGAATGAGGGCATCGTT

CCCACTGCGATGCTGGTTGCCAACGATCAGATGGCGCTGGGCGCAATGCGCGCCATTACCGAGTCCGGGCTGC

GCGTTGGTGCGGATATCTCGGTAGTGGGATACGACGATACCGAAGACAGCTCATGTTATATCCCGCCGTTAAC

CACCATCAAACAGGATTTTCGCCTGCTGGGGCAAACCAGCGTGGACCGCTTGCTGCAACTCTCTCAGGGCCAG

GCGGTGAAGGGCAATCAGCTGTTGCCCGTCTCACTGGTGAAAAGAAAAACCACCCTGGCGCCCAATACGCAAA

CCGCCTCTCCCCGCGCGTTGGCCGATTCATTAATGCAGCTGGCACGACAGGTTTCCCGACTGGAAAGCGGACA

GTAAGGTACCATAGGATCCaggcacagga
```

The construct was delivered to the chromosome using a recombinant phage called AGebg-LacIQ#5 into F'tet/GM101. After recombination and resolution only the chromosomal insert described above remains in the cell. It was renamed F'tet/GM221. The F'tet episome was cured from the strain using acridine orange at a concentration of 25 $\mu$g/ml in LB. The cured strain was identified as tetracyline sensitive and was stored as GM221.

Expression

Cultures of pAMG21-Fc-TMP-TMP in *E. coli* GM221 in Luria Broth medium containing 50 $\mu$g/ml kanamycin were incubated at 37° C. prior to induction. Induction of Fc-TMP-TMP gene product expression from the luxPR promoter was achieved following the addition of the synthetic autoinducer N-(3-oxohexanoyl)-DL-homoserine lactone to the culture media to a final concentration of 20 ng/ml and cultures were incubated at 37° C. for a further 3 hours. After 3 hours, the bacterial cultures were examined by microscopy for the similar expression levels of the Fc-TMP-TMP to those obtained at bench scale.

Purification of Fc-TMP-TMP

Cells are broken in water (1/10) by high pressure homogenization (2passes at 14,000 PSI) and inclusion 1 5 bodies are harvested by centrifugation (4200 RPM in J-6B for 1 hour). Inclusion bodies are solubilized in 6M guanidine, 50 mM Tris, 8 mM DTT, pH 8.7 for 1 hour at a 1/10 ratio. The solubilized mixture is diluted 20 times into 2M urea, 50 mM tris, 160 mM arginine, 3 mM cysteine, pH 8.5. The mixture is stirred overnight in the cold and then concentrated about 10 fold by ultafiltration. It is then diluted 3 fold with 10 mM Tris, 1.5M urea, pH 9. The pH of this mixture is then adjusted to pH 5 with acetic acid. The precipitate is removed by centrifugation and the supernatant is loaded onto a SP-Sepharose Fast Flow column equilibrated in 20 mM NaAc, 100 mM NaCl, pH 5(10 mg/ml protein load, room temperature). The protein is eluted off using a 20 column volume gradient in the same buffer ranging from 100 mM NaCl to 500 mM NaCl. The pool from the column is diluted 3 fold and loaded onto a SP-Sepharose HP column in 20 mM NaAc, 150 mM NaCl, pH 5(10 mg/ml protein load, room temperature). The protein is eluted off using a 20 column volume gradient in the same buffer ranging from 150 mM NaCl to 400 mM NaCl. The peak is pooled and filtered.

Characterization of Fc-TMP Activity

The following is a summary of in vivo data in mice with various compounds of this invention.

Mice: Normal female BDF1 approximately 10–12 weeks of age.

Bleed schedule: Ten mice per group treated on day 0, two groups started 4 days apart for a total of 20 mice per group. Five mice bled at each time point, mice were bled a minimum of three times a week. Mice were anesthetized with isoflurane and a total volume of 140–160 Al of blood was obtained by puncture of the orbital sinus. Blood was counted on a Technicon H1E blood analyzer running software for murine blood. Parameters measured were white blood cells, red blood cells, hematocrit, hemoglobin, platelets, neutrophils.

Treatments: Mice were either injected subcutaneously for a bolus treatment or implanted with 7-day micro-osmotic pumps for continuous delivery. Subcutaneous injections were delivered in a volume of 0.2 ml. Osmotic pumps were inserted into a subcutaneous incision made in the skin between the scapulae of anesthetized mice. Compounds were diluted in PBS with 0.1% BSA. All experiments included one control group, labeled "carrier" that were treated with this diluent only. The concentration of the test articles in the pumps was adjusted so that the calibrated flow rate from the pumps gave the treatment levels indicated in the graphs.

Compounds: A dose titration of the compound was delivered to mice in 7 day micro-osmotic pumps. Mice were treated with various compounds at a single dose of 100 µg/kg in 7 day osmotic pumps. Some of the same compounds were then given to mice as a single bolus injection.

Activity test results: The results of the activity experiments are shown in FIGS. 11 and 12. In dose response assays using 7-day micro-osmotic pumps, the maximum effect was seen with the compound of SEQ ID NO: 18 was at 100 µg/kg/day; the 10 µg/kg/day dose was about 50% maximally active and 1 µg/kg/day was the lowest dose at which activity could be seen in this assay system. The compound at 10 µg/kg/day dose was about equally active as 100 µg/kg/day unpegylated rHu-MGDF in the same experiment.

Example 3

Fc-EMP Fusions

Fc-EMP

A DNA sequence coding for the Fc region of human IgG1 fused in-frame to a monomer of the EPO-mimetic peptide was constructed using standard PCR technology. Templates for PCR reactions were a vector containing the Fc sequence (pFc-A3, described in International application WO 97/23614, published Jul. 3, 1997) and a synthetic gene encoding EPO monomer. The synthetic gene for the monomer was constructed from the 4 overlapping oligonucleotides (SEQ ID NOS: 390 to 393, respectively) shown below:

```
1798-2    TAT GAA AGG TGG AGG TGG TGG TGG AGG TAC TTA CTC TTG
          CCA CTT CGG CCC GCT GAC TTG G 1798-3    CGG TTT GCA AAC CCA AGT CAG CGG GCC GAA GTG GCA AGA
          GTA AGT ACC TCC ACC ACC ACC TCC ACC TTT CAT 1798-4    GTT TGC AAA CCG CAG GGT GGC GGC GGC GGC GGC GGT GGT
          ACC TAT TCC TGT CAT TTT 1798-5    CCA GGT CAG CGG GCC AAA ATG ACA GGA ATA GGT ACC ACC
          GCC GCC GCC GCC GCC ACC CTG
```

The 4 oligonucleotides were annealed to form the duplex encoding an amino acid sequence (SEQ ID NOS: 394 and 395, respectively) shown below:

```
    TATGAAAGGTGGAGGTGGTGGTGGAGGTACTTACTCTTGCCACTTCGGCCCGCTGACTTG
  1 ---------+---------+---------+---------+---------+---------+ 60
    TACTTTCCACCTCCACCACCACCTCCATGAATGAGAACGGTGAAGCCGGGCGACTGAAC
  b  M  K  G  G  G  G  G  G  T  Y  S  C  H  F  G  P  L  T  W

GGTTTGCAAACCGCAGGGTGGCGGCGGCGGCGGCGGTGGTACCTATTCCTGTCATTTT
 61 ---------+---------+---------+---------+---------+---------+-- 133
    CCAAACGTTTGGCGTCCCACCGCCGCCGCCGCCGCCACCATGGATAAGGACAGTAAAACCGGGCGACTGGACC
  b  V  C  K  P  Q  G  G  G  G  G  G  T  Y  S  C  H  F  -
```

This duplex was amplified in a PCR reaction using

```
1798-18   GCA GAA GAG CCT CTC CCT GTC TCC GGG TAA
          AGG TGG AGG TGG TGG TGG AGG TAC TTA
          CTC T
``` and

```
1798-19   CTA ATT GGA TCC ACG AGA TTA ACC ACC
          CTG CGG TTT GCA A
``` as the sense and antisense primers (SEQ ID NOS: 396 and 397, respectively).

The Fc portion of the molecule was generated in a PCR reaction with pFc-A3 using the primers

```
1216-52  AAC ATA AGT ACC TGT AGG ATC G 1798-17  AGA GTA AGT ACC TCC ACC ACC ACC TCC ACC TTT ACC CGG
         AGA CAG GGA GAG GCT CTT CTG C
``` which are SEQ ID NOS: 369 and 399, respectively. The oligonucleotides 1798-17 and 1798-18 contain an overlap of 61 nucleotides, allowing the two genes to be fused together in the correct reading frame by combining the above PCR products in a third reaction using the outside primers, 1216-52 and 1798-19.

The final PCR gene product (the full length fusion gene) was digested with restriction endonucleases XbaI and BamHI, and then ligated into the vector pAMG21 (described below), also digested with XbaI and BamHI. Ligated DNA was transformed into competent host cells of E. coli strain 2596 (GM221, described herein). Clones were screened for the ability to produce the recombinant protein product and to possess the gene fusion having the correct nucleotide sequence. A single such clone was selected and designated Amgen strain #3718.

The nucleotide and amino acid sequence of the resulting fusion protein (SEQ ID NOS: 15 and 16) are shown in FIG. 13.

EMP-Fc

A DNA sequence coding for a monomer of the EPO-mimetic peptide fused in-frame to the Fc region of human IgG1 was constructed using standard PCR technology. Templates for PCR reactions were the pFC-A3a vector and a synthetic gene encoding EPO monomer. The synthetic gene for the monomer was constructed from the 4 overlapping oligonucleotides 1798-4 and 1798-5 (above) and 1798-6 and 1798-7 (SEQ ID NOS: 400 and 401, respectively) shown below:

```
1798-6   GGC CCG CTG ACC TGG GTA TGT AAG CCA CAA GGG GGT GGG
         GGA GGC GGG GGG TAA TCT CGA G 1798-7   GAT CCT CGA GAT TAC CCC CCG CCT CCC CCA CCC CCT TGT
         GGC TTA CAT AC
```

The 4 oligonucleotides were annealed to form the duplex encoding an amino acid sequence (SEQ ID NOS: 402 and 403, respectively) shown below:

```
        GTTTGCAAACCGCAGGGTGGCGGCGGCGGCGGCGGTGGTACCTATTCCTGTCATTTTGGC
      1 ---------+---------+---------+---------+---------+---------+ 60
        GTCCCACCGCCGCCGCCGCCGCCACCATGGATAAGGACAGTAAAACCG
     A  V  C  K  P  Q  G  G  G  G  G  G  G  T  Y  S  C  H  F  G  -

CCGCTGACCTGGGTATGTAAGCCACAAGGGGGTGGGGGAGGCGGGGGGTAATCTCGAG
     61 ---------+---------+---------+---------+---------+---------+- 122
        GGCGACTGGACCCATACATTCGGTGTTCCCCCACCCCCTCCGCCCCCCATTAGAGCTCCTAG
     A  P  L  T  W  V  C  K  P  Q  G  G  G  G  G  G  *
```

This duplex was amplified in a PCR reaction using

```
1798-21  TTA TTT CAT ATG AAA GGT GGT AAC TAT TCC TGT CAT TTT and 1798-22  TGG ACA TGT GTG AGT TTT GTC CCC CCC GCC TCC CCC ACC
         CCC T
``` as the sense and antisense primers (SEQ ID NOS: 404 and 405, respectively).

The Fc portion of the molecule was generated in a PCR reaction with pFc-A3 using the primers

```
1798-23  AGG GGG TGG GGG AGG CGG GGG GGA CAA AAC TCA CAC ATG
         TCC A and 1200-54  GTT ATT GCT CAG CGG TGG CA
``` which are SEQ ID NOS: 406 and 407, respectively. The oligonucleotides 1798-22 and 1798-23 contain an overlap of 43 nucleotides, allowing the two genes to be fused together in the correct reading frame by combining the above PCR products in a third reaction using the outside primers, 1787-21 and 1200-54.

The final PCR gene product (the full length fusion gene) was digested with restriction endonucleases XbaI and BamHI, and then ligated into the vector pAMG21 and transformed into competent *E. coli* strain 2596 cells as described above. Clones were screened for the ability to produce the recombinant protein product and to possess the gene fusion having the correct nucleotide sequence. A single such clone was selected and designated Amgen strain #3688.

The nucleotide and amino acid sequences (SEQ ID NOS: 17 and 18) of the resulting fusion protein are shown in FIG. 14.

EMP-EMP-Fc

A DNA sequence coding for a dimer of the EPO-mimetic peptide fused in-frame to the Fc region of human IgG1 was constructed using standard PCR technology. Templates for PCR reactions were the EMP-Fc plasmid from strain #3688 above and a synthetic gene encoding the EPO dimer. The synthetic gene for the dimer was constructed from the 8 overlapping oligonucleotides (SEQ ID NOS:408 to 415, respectively) shown below:

```
1869-23  TTT TTT ATC GAT TTG ATT CTA GAT TTG AGT TTT AAC TTT
         TAG AAG GAG GAA TAA AAT ATG 1869-48  TAA AAG TTA AAA CTC AAA TCT AGA ATC AAA TCG ATA AAA
         AA 1871-72  GGA GGT ACT TAC TCT TGC CAC TTC GGC CCG CTG ACT TGG
         GTT TGC AAA CCG 1871-73  AGT CAG CGG GCC GAA GTG GCA AGA GTA AGT ACC TCC CAT
         ATT TTA TTC CTC CTT C 1871-74  CAG GGT GGC GGC GGC GGC GGC GGT GGT ACC TAT TCC TGT
         CAT TTT GGC CCG CTG ACC TGG 1871-75  AAA ATG ACA GGA ATA GGT ACC ACC GCC GCC GCC GCC GCC
         ACC CTG CGG TTT GCA AAC CCA 1871-78  GTA TGT AAG CCA CAA GGG GGT GGG GGA GGC GGG GGG GAC
         AAA ACT CAC ACA TGT CCA 1871-79  AGT TTT GTC CCC CCC GCC TCC CCC ACC CCC TTG TGG CTT
         ACA TAC CCA GGT CAG CGG GCC
```

The 8 oligonucleotides were annealed to form the duplex encoding an amino acid sequence (SEQ ID NOS: 416 and 417, respectively) shown below:

```
          TTTTTTATCGATTTGATTCTAGATTTGAGTTTTAACTTTTAGAAGGAGGAATAAAATATG
      1 ---------+---------+---------+---------+---------+---------+  60
          AAAAAATAGCTAAACTAAGATCTAAACTCAAAATTGAAAATCTTCCTCCTTATTTTATAC
      a                                                             M  -

GGAGGTACTTACTCTTGCCACTTCGGCCCGCTGACTTGGGTTTGCAAACCGCAGGGTGGC
     61 ---------+---------+---------+---------+---------+---------+ 120
          CCTCCATGAATGAGAACGGTGAAGCCGGGCGACTGAACCCAAACGTTTGGCGTCCCACCG
      a    G  G  T  Y  S  C  H  F  G  P  L  T  W  V  C  K  P  Q  G  G  -

GGCGGCGGCGGCGGTGGTACCTATTCCTGTCATTTTGGCCCGCTGACCTGGGTATGTAAG
    121 ---------+---------+---------+---------+---------+---------+ 180
          CCGCCGCCGCCGCCACCATGGATAAGGACAGTAAAACCGGGCGACTGGACCCATACATTC
      a    G  G  G  G  G  T  Y  S  C  H  F  G  P  L  T  W  V  C  K  -

CCACAAGGGGGTGGGGGAGGCGGGGGGGACAAAACTCACACATGTCCA
    181 ---------+---------+---------+---------+-------- 228
          GGTGTTCCCCCACCCCCTCCGCCCCCCCTGTTTTGA
      a    P  Q  G  G  G  G  G  G  D  K  T  H  T  C  P  -
```

This duplex was amplified in a PCR reaction using 1869-23 and 1871-79 (shown above) as the sense and antisense primers.

The Fc portion of the molecule was generated in a PCR reaction 20 with strain 3688 DNA using the primers 1798-23 and 1200-54 (shown above).

The oligonucleotides 1871-79 and 1798-23 contain an overlap of 31 nucleotides, allowing the two genes to be fused together in the correct reading frame by combining the above PCR products in a third reaction using the outside primers, 1869-23 and 1200-54.

The final PCR gene product (the full length fusion gene) was digested with restriction endonucleases XbaI and BamHI, and then ligated into the vector pAMG21 and transformed into competent E. coli strain 2596 cells as described for Fc-EMP. Clones were screened for ability to produce the recombinant protein product and possession of the gene fusion having the correct nucleotide sequence. A single such clone was selected and designated Amgen strain #3813.

The nucleotide and amino acid sequences (SEQ ID NOS: 19 and 20, respectively) of the resulting fusion protein are shown in FIG. 15. There is a silent mutation at position 145 (A to G, shown in boldface) such that the final construct has a different nucleotide sequence than the oligonucleotide 1871-72 from which it was derived.

Fc-EMP-EMP

A DNA sequence coding for the Fc region of human IgG1 fused in-frame to a dimer of the EPO-mimetic peptide was constructed using standard PCR technology. Templates for PCR reactions were the plasmids from strains 3688 and 3813 above.

The Fc portion of the molecule was generated in a PCR reaction with strain 3688 DNA using the primers 1216-52 and 1798-17 (shown above). The EMP dimer portion of the molecule was the product of a second PCR reaction with strain 3813 DNA using the primers 1798-18 (also shown above) and SEQ ID NO: 418, shown below:

Characterization of Fc-EMP Activity

Characterization was carried out in vivo as follows.

Mice: Normal female BDF1 approximately 10–12 weeks of age.

Bleed schedule: Ten mice per group treated on day 0, two groups started 4 days apart for a total of 20 mice per group. Five mice bled at each time point, mice were bled a maximum of three times a week. Mice were anesthetized with isoflurane and a total volume of 140–160 ml of blood was obtained by puncture of the orbital sinus. Blood was counted on a Technicon H1E blood analyzer running software for murine blood. Parameters measured were WBC, RBC, HCT, HGB, PLT, NEUT, LYMPH.

Treatments: Mice were either injected subcutaneously for a bolus treatment or implanted with 7 day micro-osmotic pumps for continuous delivery. Subcutaneous injections were delivered in a volume of 0.2 ml. Osmotic pumps were inserted into a subcutaneous incision made in the skin between the scapulae of anesthetized mice. Compounds were diluted in PBS with 0.1% BSA. All experiments included one control group, labeled "carrier" that were treated with this diluent only. The concentration of the test articles in the pumps was adjusted so that the calibrated flow rate from the pumps gave the treatment levels indicated in the graphs.

Experiments: Various Fc-conjugated EPO mimetic peptides (EMPs) were delivered to mice as a single bolus injection at a dose of 100 $\mu$g/kg. Fc-EMPs were delivered to mice in 7-day micro-osmotic pumps. The pumps were not replaced at the end of 7 days. Mice were bled until day 51 when HGB and HCT returned to baseline levels.

Example 4

TNF-α Inhibitors

Fc-TNF-α inhibitors

A DNA sequence coding for the Fc region of human IgG1 fused in-frame to a monomer of the TNF-α inhibitory peptide was constructed using standard PCR technology.

```
1798-20  CTA ATT GGA TCC TCG AGA TTA ACC CCC TTG TGG CTT ACAT
```

The oligonucleotides 1798-17 and 1798-18 contain an overlap of 61 nucleotides, allowing the two genes to be fused together in the correct reading frame by combining the above PCR products in a third reaction using the outside primers, 1216-52 and 1798-20.

The final PCR gene product (the full length fusion gene) was digested with restriction endonucleases XbaI and BamHI, and then ligated into the vector pAMG21 and transformed into competent E. coli strain 2596 cells as described for Fc-EMP. Clones were screened for the ability to produce the recombinant protein product and to possess the gene fusion having the correct nucleotide sequence. A single such clone was selected and designated Amgen strain #3822.

The nucleotide and amino acid sequences (SEQ ID NOS: 21 and 22 respectively) of the fusion protein are shown in FIG. 16.

The Fc and 5 glycine linker portion of the molecule was generated in a PCR reaction with DNA from the Fc-EMP fusion strain #3718 (see Example 3) using the sense primer 1216-52 and the antisense primer 2295-89 (SEQ ID NOS: 369 and 1112 respectively). The nucleotides encoding the TNF-α inhibitory peptide were provided by the PCR primer 2295-89 shown below:

```
1216-52  AAC ATA AGT ACC TGT AGG ATC G 2295-89  CCG CGG ATC CAT TAC GGA CGG TGA CCC AGA GAG GTG TTT TTG TAG
         TGC GGC AGG AAG TCA CCA CCA CCT CCA CCT TTA CCC
```

The oligonucleotide 2295-89 overlaps the glycine linker and Fc portion of the template by 22 nucleotides, with the PCR resulting in the two genes being fused together in the correct reading frame.

The PCR gene product (the full length fusion gene) was digested with restriction endonucleases NdeI and BamHI, and then ligated into the vector pAMG21 and transformed into competent E. coli strain 2596 cells as described for EMP-Fc herein. Clones were screened for the ability to produce the recombinant protein product and to possess the gene fusion having the correct nucleotide sequence. A single such clone was selected and designated Amgen strain #4544.

The nucleotide and amino acid sequences (SEQ ID NOS: 1055 and 1056) of the fusion protein are shown in FIGS. 19A and 19B.

TNF-α inhibitor-Fc

A DNA sequence coding for a TNF-α inhibitory peptide fused in-frame to the Fc region of human IgG1 was constructed using standard PCR technology. The template for the PCR reaction was a plasmid containing an unrelated peptide fused via a five glycine linker to Fc. The nucleotides encoding the TNF-α inhibitory peptide were provided by the sense PCR primer 2295-88, with primer 1200-54 serving as the antisense primer (SEQ ID NOS: 1117 and 407, respectively). The primer sequences are shown below:

```
2295-88  GAA TAA CAT ATG GAC TTC CTG CCG CAC TAC AAA AAC ACC TCT CTG GGT
         CAC CGT CCG GGT GGA GGC GGT GGG GAC AAA ACT 1200-54  GTT ATT GCT CAG CGG TGG CA
```

The oligonucleotide 2295-88 overlaps the glycine linker and Fc portion of the template by 24 nucleotides, with the PCR resulting in the two genes being fused together in the correct reading frame.

The PCR gene product (the full length fusion gene) was digested with restriction endonucleases NdeI and BamHI, and then ligated into the vector pAMG21 and transformed into competent E. coli strain 2596 cells as described for EMP-Fc herein. Clones were screened for the ability to produce the recombinant protein product and to possess the gene fusion having the correct nucleotide sequence. A single such clone was selected and designated Amgen strain #4543. The nucleotide and amino acid sequences (SEQ ID NOS: 1057 and 1058) of the fusion protein are shown in FIGS. 20A and 20B.

Expression in E. coli

Cultures of each of the pAMG21-Fc-fusion constructs in E. coli GM221 were grown at 37° C. in Luria Broth medium containing 50 mg/ml kanamycin. Induction of gene product expression from the luxPR promoter was achieved following the addition of the synthetic autoinducer N-(3-oxohexanoyl)-DL-homoserine lactone to the culture media to a final concentration of 20 ng/ml. Cultures were incubated at 37° C. for a further 3 hours. After 3 hours, the bacterial cultures were examined by microscopy for the presence of inclusion bodies and were then collected by centrifugation. Refractile inclusion bodies were observed in induced cultures indicating that the Fc-fusions were most likely produced in the insoluble fraction in E. coli. Cell pellets were lysed directly by resuspension in Laemmli sample buffer containing 10% β-mercaptoethanol and were analyzed by SDS-PAGE. In each case, an intense coomassie-stained band of the appropriate molecular weight was observed on an SDS-PAGE gel.

Purification of Fc-peptide fusion proteins. Cells are broken in water (1/10) by high pressure homogenization (2 passes at 14,000 PSI) and inclusion bodies are harvested by centrifugation (4200 RPM in J-6B for 1 hour). Inclusion bodies are solubilized in 6M guanidine, 50 mM Tris, 8 mM DTT, pH 8.7 for 1 hour at a 1/10 ratio. The solubilized mixture is diluted 20 times into 2M urea, 50 mM tris, 160 mM arginine, 3 mM cysteine, pH 8.5. The mixture is stirred overnight in the cold and then concentrated about 10 fold by ultafiltration. It is then diluted 3 fold with 10 mM Tris, 1.5M urea, pH 9. The pH of this mixture is then adjusted to pH 5 with acetic acid. The precipitate is removed by centrifugation and the supernatant is loaded onto a SP-Sepharose Fast Flow column equilibrated in 20 mM NaAc, 100 mM NaCl, pH 5 (10 mg/ml protein load, room temperature). The protein is eluted from the column using a 20 column volume gradient in the same buffer ranging from 100 mM NaCl to 500 mM NaCl. The pool from the column is diluted 3 fold and loaded onto a SP-Sepharose HP column in 20 mM NaAc, 150 mM NaCl, pH 5(10 mg/ml protein load, room temperature). The protein is eluted using a 20 column volume gradient in the same buffer ranging from 150 mM NaCl to 400 mM NaCl. The peak is pooled and filtered.

Characterization of activity of Fc-TNF-α Inhibitor and TNF-α Inhibitor-Fc

Binding of these peptide fusion proteins to TNF-α can be characterized by BIAcore by methods available to one of ordinary skill in the art who is armed with the teachings of the present specification.

Example 5

IL-1 Antagonists

Fc-IL-1 Antagonist

A DNA sequence coding for the Fc region of human IgG1 fused in-frame to a monomer of an IL-1 antagonist peptide was constructed using standard PCR technology. The Fc and 5 glycine linker portion of the molecule was generated in a PCR reaction with DNA from the Fc-EMP fusion strain #3718 (see Example 3) using the sense primer 1216-52 and the antisense primer 2269-70 (SEQ ID NOS: 369 and 1118, respectively). The nucleotides encoding the IL-1 antagonist peptide were provided by the PCR primer 2269-70 shown below:

```
1216-52  AAC ATA AGT ACC TGT AGG ATC G 2269-70  CCG CGG ATC CAT TAC AGC GGC AGA GCG TAC GGC TGC AGT AA CCC GGG GTC CAT
         TCG AAA CCA CCA CCT CCA CCT TTA CCC
```

The oligonucleotide 2269-70 overlaps the glycine linker and Fc portion of the template by 22 nucleotides, with the PCR resulting in the two genes being fused together in the correct reading frame.

The PCR gene product (the full length fusion gene) was digested with restriction endonucleases NdeI and BamHI, and then ligated into the vector pAMG21 and transformed into competent E. coli strain 2596 cells as described for EMP-Fc herein. Clones were screened for the ability to produce the recombinant protein product and to possess the gene fusion having the correct nucleotide sequence. A single such clone was selected and designated Amgen strain #4506.

The nucleotide and amino acid sequences (SEQ ID NOS: 1059 and 1060) of the fusion protein are shown in FIGS. 21A and 21B.

IL-1 Antagonist-Fc

A DNA sequence coding for an IL-1 antagonist peptide fused in-frame to the Fc region of human IgG1 was constructed using standard PCR technology. The template for the PCR reaction was a plasmid containing an unrelated peptide fused via a five glycine linker to Fc. The nucleotides encoding the IL-1 antagonist peptide were provided by the sense PCR primer 2269-69, with primer 1200-54 serving as the antisense primer (SEQ ID NOS: 1119 and 407, respectively). The primer sequences are shown below:

```
2269-69  GAA TAA CAT ATG TTC GAA TGG ACC CCG GGT TAC TGG CAG CCG TAC GCT
         CTG CCG CTG GGT GGA GGC GGT GGG GAC AAA ACT 1200-54  GTT ATT GCT CAG CGG TGG CA
```

The oligonucleotide 2269-69 overlaps the glycine linker and Fc portion of the template by 24 nucleotides, with the PCR resulting in the two genes being fused together in the correct reading frame.

The PCR gene product (the full length fusion gene) was digested with restriction endonucleases NdeI and BamHI, and then ligated into the vector pAMG21 and transformed into competent *E. coli* strain 2596 cells as described for EMP-Fc herein. Clones were screened for the ability to produce the recombinant protein product and to possess the gene fusion having the correct nucleotide sequence. A single such clone was selected and designated Amgen strain #4505.

The nucleotide and amino acid sequences (SEQ ID NOS: 1061 and 1062) of the fusion protein are shown in FIGS. 22A and 22B. Expression and purification were carried out as in previous examples.

Characterization of Fc-IL-1 Antagonist Peptide and IL-1 Antagonist Peptide-Fc Activity IL-1 Receptor Binding competition between IL-1β, IL-1RA and Fc-conjugated IL-1 peptide sequences was carried out using the IGEN system. Reactions contained 0.4 nM biotin-IL-1R+15 nM IL-1-TAG+3 uM competitor+20 ug/ml streptavidin-conjugate beads, where competitors were IL-1RA, Fc-IL-1 antagonist, IL-1 antagonist-Fc).

Competition was assayed over a range of competitor concentrations from 3 uM to 1.5 pM. The results are shown in Table C below:

TABLE C

Results from IL-1 Receptor Binding Competition Assay

|  | IL-1pep-Fc | Fc-IL-1pep | IL-1ra |
|---|---|---|---|
| KI | 281.5 | 59.58 | 1.405 |
| EC50 | 530.0 | 112.2 | 2.645 |
| 95% Confidence Intervals | | | |
| EC50 | 280.2 to 1002 | 54.75 to 229.8 | 1.149 to 6.086 |
| KI | 148.9 to 532.5 | 29.08 to 122.1 | 0.6106 to 3.233 |

TABLE C-continued

Results from IL-1 Receptor Binding Competition Assay

|  | IL-1pep-Fc | Fc-IL-1pep | IL-1ra |
|---|---|---|---|
| Goodness of Fit | | | |
| $R^2$ | 0.9790 | 0.9687 | 0.9602 |

Example 6

VEGF-antagonists

Fc-VEGF Antagonist

A DNA sequence coding for the Fc region of human IgG1 fused in-frame to a monomer of the VEGF mimetic peptide was constructed using standard PCR technology. The templates for the PCR reaction were the pFc-A3 plasmid and a synthetic VEGF mimetic peptide gene. The synthetic gene was assembled by annealing the following two oligonucleotides primer (SEQ ID NOS: 1110 and 1111, respectively):

```
2293-11  GTT GAA CCG AAC TGT GAC ATC CAT GTT ATG TGG GAA TGG GAA
         TGT TTT GAA CGT CTG 2293-12  CAG ACG TTC AAA ACA TTC CCA TTC CCA CAT AAC ATG GAT GTC
         ACA GTT CGG TTC AAC
```

The two oligonucleotides anneal to form the following duplex encoding an amino acid sequence shown below (SEQ ID NOS: 1113 and 1114):

```
    GTTGAACCGAACTGTGACATCCATGTTATGTGGGAATGGGAATGTTTTGAACGTCTG
1   ---------+---------+---------+---------+---------+------- 57
    CAACTTGGCTTGACACTGTAGGTACAATACACCCTTACCCTTACAAAACTTGCAGAC
a   V  E  P  N  C  D  I  H  V  M  W  E  W  E  C  F  E  R  L
-
```

This duplex was amplified in a PCR reaction using 2293-05 and 2293-06 as the sense and antisense primers (SEQ ID NOS: 1122 and 1123).

The Fc portion of the molecule was generated in a PCR reaction with the pFc-A3 plasmid using the primers 2293-03 and 2293-04 as the sense and antisense primers (SEQ ID NOS: 1120 and 1121, respectively). The full length fusion gene was obtained from a third PCR reaction using the outside primers 2293-03 and 2293-06. These primers are shown below:

```
2293-03  ATT TGA TTC TAG AAG GAG GAA TAA CAT ATG GAC AAA ACT CAC
         ACA TGT 2293-04  GTC ACA GTT CGG TTC AAC ACC ACC ACC ACC ACC TTT ACC CGG
         AGA CAG GGA 2293-05  TCC CTG TCT CCG GGT AAA GGT GGT GGT GGT GGT GTT GAA CCG
         AAC TGT GAC ATC 2293-06  CCG CGG ATC CTC GAG TTA CAG ACG TTC AAA ACA TTC CCA
```

The PCR gene product (the full length fusion gene) was digested with restriction endonucleases NdeI and BamHI, and then ligated into the vector pAMG21 and transformed into competent *E. coli* strain 2596 cells as described for EMP-Fc herein. Clones were screened for the ability to produce the recombinant protein product and to possess the gene fusion having the correct nucleotide sequence. A single such clone was selected and designated Amgen strain #4523.

The nucleotide and amino acid sequences (SEQ ID NOS: 1063 and 1064) of the fusion protein are shown in FIGS. 23A and 23B.

VEGF Antagonist-Fc

A DNA sequence coding for a VEGF mimetic peptide fused in-frame to the Fc region of human IgG1 was constructed using standard PCR technology. The templates for the PCR reaction were the pFc-A3 plasmid and the synthetic VEGF mimetic peptide gene described above. The synthetic duplex was amplified in a PCR reaction using 2293-07 and 2293-08 as the sense and antisense primers (SEQ ID NOS: 1124 and 1125, respectively).

The Fc portion of the molecule was generated in a PCR reaction with the pFc-A3 plasmid using the primers 2293-09 and 2293-10 as the sense and antisense primers (SEQ ID NOS. 1126 and 1127, respectively). The full length fusion gene was obtained from a third PCR reaction using the outside primers 2293-07 and 2293-10. These primers are shown below:

The PCR gene product (the full length fusion gene) was digested with restriction endonucleases NdeI and BamHI, and then ligated into the vector pAMG21 and transformed into competent *E. coli* strain 2596 cells as described for EMP-Fc herein. Clones were screened for the ability to produce the recombinant protein product and to possess the gene fusion having the correct nucleotide sequence. A single such clone was selected and designated Amgen strain #4524.

The nucleotide and amino acid sequences (SEQ ID NOS: 1065 and 1066) of the fusion protein are shown in FIGS. 24A and 24B. Expression and purification were carried out as in previous examples.

Example 7

MMP Inhibitors

Fc-MMP Inhibitor

A DNA sequence coding for the Fc region of human IgG1 fused in-frame to a monomer of an MMP inhibitory peptide was constructed using standard PCR technology. The Fc and 5 glycine linker portion of the molecule was generated in a PCR reaction with DNA from the Fc-TNF-α inhibitor fusion strain #4544 (see Example 4) using the sense primer 1216-52 and the antisense primer 2308-67 (SEQ ID NOS: 369 and 1115, respectively). The nucleotides encoding the MMP inhibitor peptide were provided by the PCR primer 2308-67 shown below:

```
2293-07  ATT TGA TTC TAG AAG GAG GAA TAA CAT ATG GTT GAA CCG AAC
         TGT GAC 2293-08  ACA TGT GTG AGT TTT GTC ACC ACC ACC ACC ACC CAG ACG TTC
         AAA ACA TTC 2293-09  GAA TGT TTT GAA CGT CTG GGT GGT GGT GGT GGT GAC AAA ACT
         CAC ACA TGT 2293-10  CCG CGG ATC CTC GAG TTA TTT ACC CGG AGA CAG GGA GAG
```

```
1216-52  AAC ATA AGT ACC TGT AGG ATC G 2308-67  CCG CGG ATC CAT TAG CAC AGG GTG AAA CCC CAG TGG GTG GTG
         CAA CCA CCA CCT CCA CCT TTA CCC
```

The oligonucleotide 2308-67 overlaps the glycine linker and Fc portion of the template by 22 nucleotides, with the PCR resulting in the two genes being fused together in the correct reading frame.

MMP Inhibitor-Fc

A DNA sequence coding for an MMP inhibitory peptide fused in-frame to the Fc region of human IgG1 was constructed using standard PCR technology. The Fc and glycine linker portion of the molecule was generated in a PCR reaction with DNA from the Fc-TNF-α inhibitor fusion strain #4543 (see Example 4). The nucleotides encoding the MMP inhibitory peptide were provided by the sense PCR primer 2308-66, with primer 1200-54 serving as the antisense primer (SEQ ID NOS: 1116 and 407, respectively). The primer sequences are shown below:

```
2308-66  GAA TAA CAT ATG TGC ACC ACC CAC TGG GGT TTC ACC CTG TGC
         GGT GGA GGC GGT GGG GAC AAA 1200-54  GTT ATT GCT CAG CGG TGG CA
```

The oligonucleotide 2269-69 overlaps the glycine linker and Fc portion of the template by 24 nucleotides, with the PCR resulting in the two genes being fused together in the correct reading frame.

The PCR gene product (the full length fusion gene) was digested with restriction endonucleases NdeI and BamHI, and then ligated into the vector pAMG21 and transformed into competent *E. coli* strain 2596 cells as described for EMP-Fc herein. Clones were screened for the ability to produce the recombinant protein product and to possess the gene fusion having the correct nucleotide sequence. A single such clone was selected and designated Amgen strain #4598.

The nucleotide and amino acid sequences (SEQ ID NOS: 1069 and 1070) of the fusion protein are shown in FIGS. 26A and 26B.

The invention now being fully described, it will be apparent to one of ordinary skill in the art that many changes and modifications can be made thereto, without departing from the spirit and scope of the invention as set forth herein.

ABBREVIATIONS

Abbreviations used throughout this specification are as defined below, unless otherwise defined in specific circumstances.

| | |
|---|---|
| Ac | acetyl (used to refer to acetylated residues) |
| AcBpa | acetylated p-benzoyl-L-phenylalanine |
| ADCC | antibody-dependent cellular cytotoxicity |
| Aib | aminoisobutyric acid |
| bA | beta-alanine |
| Bpa | p-benzoyl-L-phenylalanine |
| BrAc | bromoacetyl (BrCH$_2$C(O)) |
| BSA | Bovine serum albumin |
| Bzl | Benzyl |
| Cap | Caproic acid |
| CTL | Cytotoxic T lymphocytes |
| CTLA4 | Cytotoxic T lymphocyte antigen 4 |
| DARC | Duffy blood group antigen receptor |
| DCC | Dicylcohexylcarbodiimide |
| Dde | 1-(4,4-dimethyl-2,6-dioxo-cyclohexylidene)ethyl |
| EMP | Erythropoietin-mimetic peptide |
| ESI-MS | Electron spray ionization mass spectrometry |
| EPO | Erythropoietin |
| Fmoc | fluorenylmethoxycarbonyl |
| G-CSF | Granulocyte colony stimulating factor |
| GH | Growth hormone |
| HCT | hematocrit |
| HGB | hemoglobin |
| hGH | Human growth hormone |
| HOBt | 1-Hydroxybenzotriazole |
| HPLC | high performance liquid chromatography |
| IL | interleukin |
| IL-R | interleukin receptor |
| IL-1R | interleukin-1 receptor |
| IL-1ra | interleukin-1 receptor antagonist |
| Lau | Lauric acid |
| LPS | lipopolysaccharide |
| LYMPH | lymphocytes |
| MALDI-MS | Matrix-assisted laser desorption ionization mass spectrometry |
| Me | methyl |
| MeO | methoxy |
| MHC | major histocompatibility complex |
| MMP | matrix metalloproteinase |
| MMPI | matrix metalloproteinase inhibitor |
| 1-Nap | 1-napthylalanine |
| NEUT | neutrophils |
| NGF | nerve growth factor |
| Nle | norleucine |
| NMP | N-methyl-2-pyrrolidinone |
| PAGE | polyacrylamide gel electrophoresis |
| PBS | Phosphate-buffered saline |
| Pbf | 2,2,4,6,7-pendamethyldihydrobenzofuran-5-sulfonyl |
| PCR | polymerase chain reaction |
| Pec | pipecolic acid |
| PEG | Poly(ethylene glycol) |
| pGlu | pyroglutamic acid |
| Pic | picolinic acid |
| PLT | platelets |
| pY | phosphotyrosine |
| RBC | red blood cells |
| RBS | ribosome binding site |
| RT | room temperature (25° C.) |
| Sar | sarcosine |
| SDS | sodium dodecyl sulfate |
| STK | serine-threonine kinases |
| t-Boc | tert-Butoxycarbonyl |
| tBu | tert-Butyl |
| TGF | tissue growth factor |
| THF | thymic humoral factor |
| TK | tyrosine kinase |
| TMP | Thrombopoietin-mimetic peptide |

| | |
|---|---|
| TNF | Tissue necrosis factor |
| TPO | Thrombopoietin |
| TRAIL | TNF-related apoptosis-inducing ligand |
| Trt | trityl |
| UK | urokinase |
| UKR | urokinase receptor |
| VEGF | vascular endothelial cell growth factor |
| VIP | vasoactive intestinal peptide |
| WBC | white blood cells |

SEQUENCE LISTING (1133 sequences)

SEQ ID NO: 1 - DNA, 684 bp, HUMAN
  CDS (1)..(684)
atggacaaaactcacacatgtccaccttgtccagctccggaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2 - protein, 228 aa, HUMAN
MDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3 - protein, 36 aa, Artificial Sequence
  SYNTHETIC SCHEME FOR PREPARATION OF PEGYLATED PEPTIDE
  misc_feature (18)..(18): Methoxy-polyethylene glycol (5000 Dalton)-sulfoacetyl group attac hed to the sidechain.
IEGPTLRQWLAARAGGGKGGGGIEGPTLRQWLAARA

SEQ ID NO: 4 - protein, 36 aa, Artificial Sequence
  SYNTHETIC SCHEME FOR PREPARATION OF PEGYLATED PEPTIDE
  misc_feature (18)..(18): Methoxy-polyethylene glycol (5000 Dalton)-succinimidyl group atta ched to the sidechain.
IEGPTLRQWLAARAGGGCGGGGIEGPTLRQWLAARA

SEQ ID NO: 5 - DNA, 794 bp, Artificial Sequence
  Fc-TMP
  CDS (39)..(779)
tctagatttgttttaactaattaaaggaggaataacatatggacaaaactcacacatgtccaccttgtccagctccggaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggaggtggtggtatcgaaggtccgactctgcgtcagtggctggctgctcgtgcttaatctcgaggatcc

SEQ ID NO: 6 - protein, 247 aa, Artificial Sequence
  Fc-TMP
MDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGGIEGPTLRQWLAARA

SEQ ID NO: 7 - DNA, 861 bp, Artificial Sequence
  Fc-TMP-TMP
  CDS (39)..(842)
tctagatttgttttaactaattaaaggaggaataacatatggacaaaactcacacatgtccaccttgtccagctccggaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggaggtggtggtatcgaaggtccgactctgcgtcagtggctggctgctcgtgctggtggtggaggtggcggcggaggtattgagggcccaacccttcgccaatggcttgcagcacgcgcataatctcgaggatccg

SEQ ID NO: 8 - protein, 268 aa, Artificial Sequence
  Fc-TMP-TMP
MDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGGIEGPTLRQWLAARAGGGGGGGGIEGPTLRQWLAAR

SEQ ID NO: 9 - DNA, 855 bp, Artificial Sequence
  TMP-TMP-Fc
  CDS (39)..(845)
tctagatttgttttaactaattaaaggaggaataacatatgatcgaaggtccgactctgcgtcagtggctggctgctcgtgctggcggtggtggcggagggggtggcattgagggcccaacccttcgccaatggcttgcagcacgcgcagggggaggcggtggggacaaaactcacacatgtccaccttgcccagcacctgaactcctggggggaccgtcagttttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaataatggatcc

SEQ ID NO: 10 - protein, 269 aa, Artificial Sequence
  TMP-TMP-Fc
MIEGPTLRQWLAARAGGGGGGGGIEGPTLRQWLAARAGGGGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11 - DNA, 789 bp, Artificial Sequence
  TMP-Fc
  CDS (39)..(779)
tctagatttgttttaactaattaaaggaggaataacatatgatcgaaggtccgactctgcgtcagtggctggctgctcgtgctggtggaggcggtggggacaaaactcacacatgtccaccttgcccagcacctgaactcctggggggaccgtcagttttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaataatggatcc

SEQ ID NO: 12 - protein, 247 aa, Artificial Sequence
  TMP-Fc
MIEGPTLRQWLAARAGGGGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13 - protein, 14 aa, Artificial Sequence
  TMP
IEGPTLRQWLAARA

SEQ ID NO: 14 - protein, 36 aa, Artificial Sequence
  TMP-TMP
IEGPTLRQWLAARAGGGGGGGGIEGPTLRQWLAARA

SEQ ID NO: 15 - DNA, 812 bp, Artificial Sequence
  Fc-EMP
  CDS (39)..(797)
tctagatttgttttaactaattaaaggaggaataacatatggacaaaactcacacatgtccaccttgtccagctccggaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggaggtggtggtggaggtacttactcttgccacttcggcccgctgacttgggtttgcaaaccgcagggtggttaatctcgtggatcc

SEQ ID NO: 16 - protein, 253 aa, Artificial Sequence
  Fc-EMP
MDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGGGGTYSCHFGPLTWVCKPQGG

SEQ ID NO: 17 - DNA, 807 bp, Artificial Sequence
  EMP-Fc
  CDS (39)..(797)
tctagatttgttttaactaattaaaggaggaataacatatgggaggtacttactcttgccacttcggcccgctgacttgggtatgtaagccacaagggggtgggggaggcgggggggacaaaactcacacatgtccaccttgcccagcacctgaactcctggggggaccgtcagttttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaataatggatcc

SEQ ID NO: 18 - protein, 253 aa, Artificial Sequence
  EMP-Fc
MGGTYSCHFGPLTWVCKPQGGGGGGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 19 - DNA, 881 bp, Artificial Sequence
  EMP-EMP-Fc
  CDS (41)..(871)
tctagatttgagttttaacttttagaaggaggaataaaatatgggaggtacttactcttgccacttcggcccactgacttgggtttgcaaaccgcagggtggcggcggcggcggcggtggtacctattcctgtcattttggcccgctgacctgggtatgtaagccacaagggggtgggggaggcgggggggacaaaactcacacatgtccaccttgcccagcacctgaactcctggggggaccgtcagttttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaataatggatcc

SEQ ID NO: 20 - protein, 277 aa, Artificial Sequence [sequence omitted]

SEQ ID NO: 21 - DNA, 885 bp, Artificial Sequence
  Fc-EMP-EMP
  CDS (39)..(869)
tctagatttgttttaactaattaaaggaggaataacatatggacaaaactcacacatgtccaccttgcccagcacctgaactcctggggggaccgtcagttttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcctccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggaggtggtggcggaggtacttactcttgccacttcggcccactgacttgggtttgcaaaccgcagggtggcggcggcggcggcggtggtacctattcctgtcattttggcccgctgacctgggtatgtaagccacaagggggttaatctcgaggatcca

SEQ ID NO: 22 - protein, 277 aa, Artificial Sequence
  Fc-EMP-EMP
MDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGGGGTYSCHFGPLTWVCKPQGGGGGGGGTYSCHFGPLTWVCKPQGG

SEQ ID NO: 23 - DNA, 1546 bp, Artificial Sequence
  pAMG21
gcgtaacgtatgcatggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatggacgtcgtacttaacttttaaagtatgggcaatcaattgctcctgttaaaattgctttagaaatactttggcagcggtttgttgtattgagtttcatttgcgcattggttaaatggaaagtgaccgtgcgcttactacagcctaatatttttgaaatatcccaagagctttttccttcgcatgcccacgctaaacattctttttctcttttggttaaatcgttgtttgatttattatttgctatatttatttttcgataattatcaactagagaaggaacaattaatggtatgttcatacacgcatgtaaaaataaactatctatatagttgtctttctctgaatgtgcaaaactaagcattccgaagccattattagcagtatgaatagggaaactaaacccagtgataagacctgatgatttcgcttctttaattacatttggagattttttatttacagcattgttttcaaatatattccaattaatcggtgaatgattggagttagaataatctactataggatcatattttattaaattagcgtcatcataatattgcctccattttttagggtaattatccagaattgaaatatcagatttaaccatagaatgaggataaatgatcgcgagtaaataatattcacaatgtaccattttagtcatatcagataagcattgattaatatcattattgcttctacaggctttaattttattaattattctgtaagtgtcgtcggcatttatgtctttcatacccatctctttatccttacctattgtttgtcgcaagttttgcgtgttatatatcattaaaacggtaatagattgacatttgattctaataaattggatttttgtcacactattatatcgcttgaaatacaattgtttaacataagtacctgtaggatcgtacaggtttacgcaagaaaatggtttgttatagtcgattaatcgatttgattctagatttgttttaactaattaaaggaggaataacatatggttaacgcgttggaattcgagctcactagtgtcgacctgcagggtaccatggaagcttactcgaggatccgcggaaagaagaagaagaagaagaaagcccgaaaggaagctgagttggctgctgccaccgctgagcaataactagcataaccccttggggcctctaaacgggtcttgaggggttttttgctgaaaggaggaaccgctcttcacgctcttcacgc

SEQ ID NO: 24 - protein, 14 aa, Artificial Sequence
  TPO-MIMETIC PEPTIDE
IEGPTLRQWLAAKA

SEQ ID NO: 25 - protein, 14 aa, Artificial Sequence
  TPO-MIMETIC PEPTIDE
IEGPTLREWLAARA

SEQ ID NO: 26 - protein, 14 aa, Artificial Sequence
  TPO-MIMETIC PEPTIDE
  misc_feature (14)..(14): At position 14, amino acid linker to an identical sequence
IEGPTLRQWLAARA

SEQ ID NO: 27 - protein, 14 aa, Artificial Sequence
  TPO-MIMETIC PEPTIDE
  misc_feature (14)..(14): At position 14, amino acid linker to an identical sequence
IEGPTLRQWLAAKA

SEQ ID NO: 28 - protein, 14 aa, Artificial Sequence
  TPO-MIMETIC PEPTIDE
  misc_feature (9)..(9): At position 9 disulfide linkage to position 9 of an identical seq uence
  misc_feature (14)..(14): At position 14, amino acid linker to an identical sequence
IEGPTLRQCLAARA

SEQ ID NO: 29 - protein, 14 aa, Artificial Sequence
  TPO-MIMETIC PEPTIDE
  misc_feature (16)..(16): Position 16 bromoacetyl group linked to sidechain
  misc_feature (14)..(14): At position 14, amino acid linker attached N-to-C to Lys and to a nother linker and an identical sequence
IEGPTLRQWLAARA

SEQ ID NO: 30 - protein, 14 aa, Artificial Sequence
  TPO-MIMETIC PEPTIDE
  misc_feature (16)..(16): Position 16 polyethylene glycol linked to sidechain
  misc_feature (14)..(14): At position 14, amino acid linker attached N-to-C to Lys and to a nother linker and an identical sequence
IEGPTLRQWLAARA

SEQ ID NO: 31 - protein, 14 aa, Artificial Sequence
  TPO-MIMETIC PEPTIDE
  misc_feature (9)..(9): Position 9 disulfide bond to residue 9 of a separate identical se quence
  misc_feature (14)..(14): At position 14, amino acid linker to an identical sequence
IEGPTLRQCLAARA

SEQ ID NO: 32 - protein, 14 aa, Artificial Sequence
  TPO-MIMETIC PEPTIDE
  misc_feature (14)..(14): At position 14, amino acid linker attachment site
IEGPTLRQWLAARA

SEQ ID NO: 33 - protein, 9 aa, Artificial Sequence
  TPO MIMETIC PEPTIDE
  misc_feature (6, 7 and)..(8): Xaa = any amino acid
VRDQIXXXL

SEQ ID NO: 34 - protein, 6 aa, Artificial Sequence
  TPO-MIMETIC PEPTIDE
TLREWL

SEQ ID NO: 35 - protein, 10 aa, Artificial Sequence
  TPO-MIMETIC PEPTIDE
GRVRDQVAGW

SEQ ID NO: 36 - protein, 10 aa, Artificial Sequence
  TPO-MIMETIC PEPTIDE
GRVKDQIAQL

SEQ ID NO: 37 - protein, 10 aa, Artificial Sequence
  TPO-MIMETIC PEPTIDE
GVRDQVSWAL

SEQ ID NO: 38 - protein, 10 aa, Artificial Sequence
  TPO-MIMETIC PEPTIDE
ESVREQVMKY

SEQ ID NO: 39 - protein, 10 aa, Artificial Sequence
  TPO-MIMETIC PEPTIDE
SVRSQISASL

SEQ ID NO: 40 - protein, 10 aa, Artificial Sequence
  TPO-MIMETIC PEPTIDE
GVRETVYRHM

SEQ ID NO: 41 - protein, 11 aa, Artificial Sequence
  TPO-MIMETIC PEPTIDE
GVREVIVMHML

SEQ ID NO: 42 - protein, 11 aa, Artificial Sequence
  TPO-MIMETIC PEPTIDE
GRVRDQIWAAL

SEQ ID NO: 43 - protein, 11 aa, Artificial Sequence
  TPO-MIMETIC PEPTIDE
AGVRDQILIWL

SEQ ID NO: 44 - protein, 11 aa, Artificial Sequence
  TPO-MIMETIC PEPTIDE
GRVRDQIMLSL

SEQ ID NO: 45 - protein, 11 aa, Artificial Sequence
  TPO-MIMETIC PEPTIDE
  misc_feature (8)..(10): Xaa = any amino acid
GRVRDQIXXXL

SEQ ID NO: 46 - protein, 10 aa, Artificial Sequence
  TPO-MIMETIC PEPTIDE
CTLRQWLQGC

SEQ ID NO: 47 - protein, 10 aa, Artificial Sequence
  TPO-MIMETIC PEPTIDE
CTLQEFLEGC

SEQ ID NO: 48 - protein, 10 aa, Artificial Sequence
  TPO-MIMETIC PEPTIDE
CTRTEWLHGC

SEQ ID NO: 49 - protein, 12 aa, Artificial Sequence
  TPO-MIMETIC PEPTIDE
CTLREWLHGGFC

SEQ ID NO: 50 - protein, 12 aa, Artificial Sequence
  TPO-MIMETIC PEPTIDE
CTLREWVFAGLC

SEQ ID NO: 51 - protein, 13 aa, Artificial Sequence
  TPO-MIMETIC PEPTIDE
CTLRQWLILLGMC

SEQ ID NO: 52 - protein, 14 aa, Artificial Sequence
  TPO-MIMETIC PEPTIDE
CTLAEFLASGVEQC

SEQ ID NO: 53 - protein, 14 aa, Artificial Sequence
  TPO-MIMETIC PEPTIDE
CSLQEFLSHGGYVC

SEQ ID NO: 54 - protein, 14 aa, Artificial Sequence
  TPO-MIMETIC PEPTIDE
CTLREFLDPTTAVC

SEQ ID NO: 55 - protein, 14 aa, Artificial Sequence
  TPO-MIMETIC PEPTIDE
CTLKEWLVSHEVWC

SEQ ID NO: 56 - protein, 10 aa, Artificial Sequence
  TPO-MIMETIC PEPTIDE
  misc_feature (8)..(9): Xaa = any amino acid
CTLREWLXXC

SEQ ID NO: 57 - protein, 11 aa, Artificial Sequence
  TPO-MIMETIC PEPTIDE
  misc_feature (8)..(10): Xaa = any amino acid
CTLREWLXXXC

SEQ ID NO: 58 - protein, 12 aa, Artificial Sequence
  TPO-MIMETIC PEPTIDE
  misc_feature (8)..(11): Xaa = any amino acid
CTLREWLXXXXC

SEQ ID NO: 59 - protein, 13 aa, Artificial Sequence
  TPO-MIMETIC PEPTIDE
  misc_feature (8)..(12): Xaa = any amino acid
CTLREWLXXXXXC

SEQ ID NO: 60 - protein, 14 aa, Artificial Sequence
  TPO-MIMETIC PEPTIDE
  misc_feature (8)..(13): Xaa = any amino acid
CTLREWLXXXXXXC

SEQ ID NO: 61 - protein, 10 aa, Artificial Sequence
  TPO-MIMETIC PEPTIDE
REGPTLRQWM

SEQ ID NO: 62 - protein, 10 aa, Artificial Sequence
  TPO-MIMETIC PEPTIDE
EGPTLRQWLA

SEQ ID NO: 63 - protein, 10 aa, Artificial Sequence
  TPO-MIMETIC PEPTIDE
ERGPFWAKAC

SEQ ID NO: 64 - protein, 10 aa, Artificial Sequence
  TPO-MIMETIC PEPTIDE
REGPRCVMWM

SEQ ID NO: 65 - protein, 14 aa, Artificial Sequence
  TPO-MIMETIC PEPTIDE
CGTEGPTLSTWLDC

SEQ ID NO: 66 - protein, 14 aa, Artificial Sequence
  TPO-MIMETIC PEPTIDE
CEQDGPTLLEWLKC

SEQ ID NO: 67 - protein, 14 aa, Artificial Sequence
  TPO-MIMETIC PEPTIDE
CELVGPSLMSWLTC

SEQ ID NO: 68 - protein, 14 aa, Artificial Sequence
  TPO-MIMETIC PEPTIDE
CLTGPFVTQWLYEC

SEQ ID NO: 69 - protein, 14 aa, Artificial Sequence
  TPO-MIMETIC PEPTIDE
CRAGPTLLEWLTLC

SEQ ID NO: 70 - protein, 14 aa, Artificial Sequence
  TPO-MIMETIC PEPTIDE
CADGPTLREWISFC

SEQ ID NO: 71 - protein, 13 aa, Artificial Sequence
  TPO-MIMETIC PEPTIDE
  misc_feature (2 )..(12): Xaa =  any amino acid
CXEGPTLREWLXC

SEQ ID NO: 72 - protein, 14 aa, Artificial Sequence
  TPO-MIMETIC PEPTIDE
  misc_feature (2, 3 )..(13): Xaa = any amino acid
CXXEGPTLREWLXC

SEQ ID NO: 73 - protein, 14 aa, Artificial Sequence
  TPO-MIMETIC PEPTIDE
  misc_feature (2, 12 )..(13): Xaa = any amino acid
CXEGPTLREWLXXC

SEQ ID NO: 74 - protein, 15 aa, Artificial Sequence
  TPO-MIMETIC PEPTIDE
  misc_feature (2, 3, 13 )..(14): Xaa = any amino acid
CXXEGPTLREWLXXC

SEQ ID NO: 75 - protein, 16 aa, Artificial Sequence
  TPO-MIMETIC PEPTIDE
GGCTLREWLHGGFCGG

SEQ ID NO: 76 - protein, 18 aa, Artificial Sequence
  TPO-MIMETIC PEPTIDE
GGCADGPTLREWISFCGG

SEQ ID NO: 77 - protein, 19 aa, Artificial Sequence
  TPO-MIMETIC PEPTIDE
GNADGPTLRQWLEGRRPKN

SEQ ID NO: 78 - protein, 19 aa, Artificial Sequence
  TPO-MIMETIC PEPTIDE
LAIEGPTLRQWLHGNGRDT

SEQ ID NO: 79 - protein, 19 aa, Artificial Sequence
  TPO-MIMETIC PEPTIDE
HGRVGPTLREWKTQVATKK

SEQ ID NO: 80 - protein, 18 aa, Artificial Sequence
  TPO-MIMETIC PEPTIDE
TIKGPTLRQWLKSREHTS

SEQ ID NO: 81 - protein, 18 aa, Artificial Sequence
  TPO-MIMETIC PEPTIDE
ISDGPTLKEWLSVTRGAS

SEQ ID NO: 82 - protein, 18 aa, Artificial Sequence
  TPO MIMETIC PEPTIDE
SIEGPTLREWLTSRTPHS

SEQ ID NO: 83 - protein, 14 aa, Artificial Sequence
  EPO-MIMETIC PEPTIDE
  misc_feature (2, 4, 5, 8, 11 )..(13): Xaa = any amino acid
YXCXXGPXTWXCXP

SEQ ID NO: 84 - protein, 28 aa, Artificial Sequence
  EPO-MIMETIC PEPTIDE
  misc_feature (2, 4, 5, 8, 11, 13, 16, 18, 19, 22, 25 )..(27): Xaa = any amino acid
YXCXXGPXTWXCXPYXCXXGPXTWXCXP

SEQ ID NO: 85 - protein, 14 aa, Artificial Sequence
  EPO-MIMETIC PEPTIDE
  misc_feature (14)..(14): At position 14, amino acid linker to an identical sequence
  misc_feature (2, 4, 5, 8, 11)..(13): Xaa = any amino acid
YXCXXGPXTWXCXP

SEQ ID NO: 86 - protein, 14 aa, Artificial Sequence
  EPO-MIMETIC PEPTIDE
  misc_feature (2, 4, 5, 8, 11 )..(13): Xaa = any amino acid
YXCXXGPXTWXCXP

SEQ ID NO: 87 - protein, 20 aa, Artificial Sequence
  EPO-MIMETIC PEPTIDE
GGTYSCHFGPLTWVCKPQGG

SEQ ID NO: 88 - protein, 20 aa, Artificial Sequence
  EPO-MIMETIC PEPTIDE
GGDYHCRMGPLTWVCKPLGG

SEQ ID NO: 89 - protein, 20 aa, Artificial Sequence
  EPO-MIMETIC PEPTIDE
GGVYACRMGPITWVCSPLGG

SEQ ID NO: 90 - protein, 20 aa, Artificial Sequence
  EPO-MIMETIC PEPTIDE
VGNYMCHFGPITWVCRPGGG

SEQ ID NO: 91 - protein, 20 aa, Artificial Sequence
  EPO-MIMETIC PEPTIDE
GGLYLCRFGPVTWDCGYKGG

SEQ ID NO: 92 - protein, 40 aa, Artificial Sequence
  EPO-MIMETIC PEPTIDE
GGTYSCHFGPLTWVCKPQGGGGTYSCHFGPLTWVCKPQGG

SEQ ID NO: 93 - protein, 20 aa, Artificial Sequence
  EPO-MIMETIC PEPTIDE
  misc_feature (20)..(20): Position 20, amino acid linker to an identical sequence
GGTYSCHFGPLTWVCKPQGG

SEQ ID NO: 94 - protein, 23 aa, Artificial Sequence
  EPO-MIMETIC PEPTIDE
GGTYSCHFGPLTWVCKPQGGSSK

SEQ ID NO: 95 - protein, 46 aa, Artificial Sequence
  EPO-MIMETIC PEPTIDE
GGTYSCHFGPLTWVCKPQGGSSKGGTYSCHFGPLTWVCKPQGGSSK

SEQ ID NO: 96 - protein, 23 aa, Artificial Sequence
  EPO-MIMETIC PEPTIDE
  misc_feature (23)..(23): Position 23, amino acid linker to an identical sequence
GGTYSCHFGPLTWVCKPQGGSSK

SEQ ID NO: 97 - protein, 22 aa, Artificial Sequence
  EPO-MIMETIC PEPTIDE
  misc_feature (22)..(22): Position 22 linked through epsilon amine to lysyl, which is linke d to a separate identical sequence through that sequence's alpha amine
GGTYSCHFGPLTWVCKPQGGSS

SEQ ID NO: 98 - protein, 23 aa, Artificial Sequence
  EPO-MIMETIC PEPTIDE
  misc_feature (23)..(23): At position 23 biotin linked to the sidechain through a linker
GGTYSCHFGPLTWVCKPQGGSSK

SEQ ID NO: 99 - protein, 5 aa, Artificial Sequence
  G-CSF-MIMETIC PEPTIDE
  misc_feature (4)..(4): At position 4 disulfide bond to residue 4 of a separate identical sequence
EEDCK

SEQ ID NO: 100 - protein, 5 aa, Artificial Sequence
  G-CSF-MIMETIC PEPTIDE
  misc_feature (4)..(4): At position 4, Xaa is an isoteric ethylene spacer linked to a sep arate identical sequence
EEDXK

SEQ ID NO: 101 - protein, 6 aa, Artificial Sequence
  G-CSF-MIMETIC PEPTIDE
  misc_feature (1)..(1): Position 1, Xaa is a pyroglutamic acid residue
  misc_feature (5)..(5): Position 5, Xaa is an isoteric ethylene spacer linked to a separa te identical sequence.
XGEDXK

SEQ ID NO: 102 - protein, 5 aa, Artificial Sequence
  G-CSF-MIMETIC PEPTIDE
  misc_feature (1)..(1): Position 1, Xaa is a picolinic acid residue
  misc_feature (4)..(4): Position 4, Xaa is an isoteric ethylene spacer linked to a separa te identical sequence.
XSDXK

SEQ ID NO: 103 - protein, 5 aa, Artificial Sequence
  G-CSF-MIMETIC PEPTIDE
  misc_feature (5)..(5): At position 5, amino acid linker to an identical sequence
EEDCK

SEQ ID NO: 104 - protein, 5 aa, Artificial Sequence
  G-CSF-MIMETIC PEPTIDE
  misc_feature (5)..(5): At position 5, amino acid linker to an identical sequence
  misc_feature (4)..(4): Xaa = any amino acid
EEDXK

SEQ ID NO: 105 - protein, 6 aa, Artificial Sequence
  ANTIVIRAL (HBV)
LLGRMK

SEQ ID NO: 106 - protein, 11 aa, Artificial Sequence
  TNF ANTAGONIST PEPTIDE
YCFTASENHCY

SEQ ID NO: 107 - protein, 11 aa, Artificial Sequence
  TNF ANTAGONIST PEPTIDE
YCFTNSENHCY

SEQ ID NO: 108 - protein, 11 aa, Artificial Sequence
  TNF ANTAGONIST PEPTIDE
YCFTRSENHCY

SEQ ID NO: 109 - protein, 9 aa, Artificial Sequence
  TNF ANTAGONIST PEPTIDE
FCASENHCY

SEQ ID NO: 110 - protein, 9 aa, Artificial Sequence
  TNF ANTAGONIST PEPTIDE
YCASENHCY

SEQ ID NO: 111 - protein, 9 aa, Artificial Sequence
  TNF ANTAGONIST PEPTIDE
FCNSENHCY

SEQ ID NO: 112 - protein, 9 aa, Artificial Sequence
  TNF ANTAGONIST PEPTIDE
FCNSENRCY

SEQ ID NO: 113 - protein, 10 aa, Artificial Sequence
  TNF ANTAGONIST PEPTIDE
FCNSVENRCY

SEQ ID NO: 114 - protein, 11 aa, Artificial Sequence
  TNF ANTAGONIST PEPTIDE
YCSQSVSNDCF

SEQ ID NO: 115 - protein, 9 aa, Artificial Sequence
  TNF ANTAGONIST PEPTIDE
FCVSNDRCY

SEQ ID NO: 116 - protein, 11 aa, Artificial Sequence
  TNF ANTAGONIST PEPTIDE
YCRKELGQVCY

SEQ ID NO: 117 - protein, 9 aa, Artificial Sequence
  TNF ANTAGONIST PEPTIDE
YCKEPGQCY

SEQ ID NO: 118 - protein, 9 aa, Artificial Sequence
  TNF ANTAGONIST PEPTIDE
YCRKEMGCY

SEQ ID NO: 119 - protein, 9 aa, Artificial Sequence
  TNF ANTAGONIST PEPTIDE
FCRKEMGCY

SEQ ID NO: 120 - protein, 9 aa, Artificial Sequence
  TNF ANTAGONIST PEPTIDE
YCWSQNLCY

SEQ ID NO: 121 - protein, 10 aa, Artificial Sequence
  TNF ANTAGONIST PEPTIDE
YCELSQYLCY

SEQ ID NO: 122 - protein, 9 aa, Artificial Sequence
  TNF ANTAGONIST PEPTIDE
YCWSQNYCY

SEQ ID NO: 123 - protein, 9 aa, Artificial Sequence
  TNF ANTAGONIST PEPTIDE
YCWSQYLCY

SEQ ID NO: 124 - protein, 10 aa, Artificial Sequence
  EPO-MIMETIC PEPTIDE
  misc_feature (1)..(1): Xaa (Pos1) can be C, A, a-amino-g-bromobutyric acid or Hoc.
  misc_feature (2)..(2): Xaa can be R, H, L or W.
  misc_feature (3)..(3): Xaa can be M, F or I.
  misc_feature (6)..(6): Xaa can be any one of the 20 L-amino acids or the stereoisomeric D-amino acids.
  misc_feature (9)..(9): Xaa can be D, E, I, L or V.
  misc_feature (10)..(10): Xaa can be a-amino-g-bromobutyric acid or Hoc, provided that eith er Xaa (Pos1) or Xaa (Pos10) is C or Hoc.
XXXGPXTWXX

SEQ ID NO: 125 - protein, 15 aa, Artificial Sequence
  CTLA4-MIMETIC
GFVCSGIFAVGVGRC

SEQ ID NO: 126 - protein, 15 aa, Artificial Sequence
  CTLA4-MIMETIC
APGVRLGCAVLGRYC

SEQ ID NO: 127 - protein, 27 aa, Artificial Sequence
  C3B ANTAGONIST
ICVVQDWGHHRCTAGHMANLTSHASAI

SEQ ID NO: 128 - protein, 13 aa, Artificial Sequence
  C3B ANTAGONIST
ICVVQDWGHHRCT

SEQ ID NO: 129 - protein, 11 aa, Artificial Sequence
  C3B ANTAGONIST
CVVQDWGHHAC

SEQ ID NO: 130 - protein, 6 aa, Artificial Sequence
  MDM/HDM ANTAGONIST PEPTIDE
TFSDLW

SEQ ID NO: 131 - protein, 12 aa, Artificial Sequence
  MDM/HDM ANTAGONIST PEPTIDE
QETFSDLWKLLP

SEQ ID NO: 132 - protein, 12 aa, Artificial Sequence
  MDM/HDM ANTAGONIST PEPTIDE
QPTFSDLWKLLP

SEQ ID NO: 133 - protein, 12 aa, Artificial Sequence
  MDM/HDM ANTAGONIST PEPTIDE
QETFSDYWKLLP

SEQ ID NO: 134 - protein, 12 aa, Artificial Sequence
  MDM/HDM ANTAGONIST PEPTIDE
QPTFSDYWKLLP

SEQ ID NO: 135 - protein, 12 aa, Artificial Sequence
  MDM/HDM ANTAGONIST PEPTIDE
MPRFMDYWEGLN

SEQ ID NO: 136 - protein, 12 aa, Artificial Sequence
  MDM/HDM ANTAGONIST PEPTIDE
VQNFIDYWTQQF

SEQ ID NO: 137 - protein, 12 aa, Artificial Sequence
  MDM/HDM ANTAGONIST PEPTIDE
TGPAFTHYWATF

SEQ ID NO: 138 - protein, 15 aa, Artificial Sequence
  MDM/HDM ANTAGONIST PEPTIDE
IDRAPTFRDHWFALV

SEQ ID NO: 139 - protein, 15 aa, Artificial Sequence
  MDM/HDM ANTAGONIST PEPTIDE
PRPALVFADYWETLY

SEQ ID NO: 140 - protein, 15 aa, Artificial Sequence
  MDM/HDM ANTAGONIST PEPTIDE
PAFSRFWSDLSAGAH

SEQ ID NO: 141 - protein, 15 aa, Artificial Sequence
  MDM/HDM ANTAGONIST PEPTIDE
PAFSRFWSKLSAGAH

SEQ ID NO: 142 - protein, 10 aa, Artificial Sequence
  MDM/HDM ANTAGONIST PEPTIDE
  misc_feature (2, 4, 8 )..(9): Xaa = any amino acid
PXFXDYWXXL

SEQ ID NO: 143 - protein, 12 aa, Artificial Sequence
  MDM/HDM ANTAGONIST PEPTIDE
QETFSDLWKLLP

SEQ ID NO: 144 - protein, 12 aa, Artificial Sequence
  MDM/HDM ANTAGONIST PEPTIDE
QPTFSDLWKLLP

SEQ ID NO: 145 - protein, 12 aa, Artificial Sequence
  MDM/HDM ANTAGONIST PEPTIDE
QETFSDYWKLLP

SEQ ID NO: 146 - protein, 12 aa, Artificial Sequence
  MDM/HDM ANTAGONIST PEPTIDE
QPTFSDYWKLLP

SEQ ID NO: 147 - protein, 12 aa, Artificial Sequence
  SELECTIN ANTAGONIST PEPTIDE
DITWDQLWDLMK

SEQ ID NO: 148 - protein, 12 aa, Artificial Sequence
  SELECTIN ANTAGONIST PEPTIDE
DITWDELWKIMN

SEQ ID NO: 149 - protein, 12 aa, Artificial Sequence
  SELECTIN ANTAGONIST PEPTIDE
DYTWFELWDMMQ

SEQ ID NO: 150 - protein, 12 aa, Artificial Sequence
  SELECTIN ANTAGONIST PEPTIDE
QITWAQLWNMMK

SEQ ID NO: 151 - protein, 12 aa, Artificial Sequence
  SELECTIN ANTAGONIST PEPTIDE
DMTWHDLWTLMS

SEQ ID NO: 152 - protein, 12 aa, Artificial Sequence
  SELECTIN ANTAGONIST PEPTIDE
DYSWHDLWEMMS

SEQ ID NO: 153 - protein, 12 aa, Artificial Sequence
  SELECTIN ANTAGONIST PEPTIDE
EITWDQLWEVMN

SEQ ID NO: 154 - protein, 12 aa, Artificial Sequence
  SELECTIN ANTAGONIST PEPTIDE
HVSWEQLWDIMN

SEQ ID NO: 155 - protein, 12 aa, Artificial Sequence
  SELECTIN ANTAGONIST PEPTIDE
HITWDQLWRIMT

SEQ ID NO: 156 - protein, 13 aa, Artificial Sequence
  SELECTIN ANTAGONIST PEPTIDE
RNMSWLELWEHMK

SEQ ID NO: 157 - protein, 18 aa, Artificial Sequence
  SELECTIN ANTAGONIST PEPTIDE
AEWTWDQLWHVMNPAESQ

SEQ ID NO: 158 - protein, 14 aa, Artificial Sequence
  SELECTIN ANTAGONIST PEPTIDE
HRAEWLALWEQMSP

SEQ ID NO: 159 - protein, 14 aa, Artificial Sequence
  SELECTIN ANTAGONIST PEPTIDE
KKEDWLALWRIMSV

SEQ ID NO: 160 - protein, 11 aa, Artificial Sequence
  SELECTIN ANTAGONIST PEPTIDE
ITWDQLWDLMK

SEQ ID NO: 161 - protein, 12 aa, Artificial Sequence
  SELECTIN ANTAGONIST PEPTIDE
DITWDQLWDLMK

SEQ ID NO: 162 - protein, 12 aa, Artificial Sequence
  SELECTIN ANTAGONIST PEPTIDE
DITWDQLWDLMK

SEQ ID NO: 163 - protein, 12 aa, Artificial Sequence
  SELECTIN ANTAGONIST PEPTIDE
DITWDQLWDLMK

SEQ ID NO: 164 - protein, 13 aa, Artificial Sequence
  CALMODULIN ANTAGONIST PEPTIDE
SCVKWGKKEFCGS

SEQ ID NO: 165 - protein, 12 aa, Artificial Sequence
  CALMODULIN ANTAGONIST PEPTIDE
SCWKYWGKECGS

SEQ ID NO: 166 - protein, 13 aa, Artificial Sequence
  CALMODULIN ANTAGONIST PEPTIDE
SCYEWGKLRWCGS

SEQ ID NO: 167 - protein, 13 aa, Artificial Sequence
  CALMODULIN ANTAGONIST PEPTIDE
SCLRWGKWSNCGS

SEQ ID NO: 168 - protein, 13 aa, Artificial Sequence
  CALMODULIN ANTAGONIST PEPTIDE
SCWRWGKYQICGS

SEQ ID NO: 169 - protein, 13 aa, Artificial Sequence
  CALMODULIN ANTAGONIST PEPTIDE
SCVSWGALKLCGS

SEQ ID NO: 170 - protein, 13 aa, Artificial Sequence
  CALMODULIN ANTAGONIST PEPTIDE
SCIRWGQNTFCGS

SEQ ID NO: 171 - protein, 13 aa, Artificial Sequence
  CALMODULIN ANTAGONIST PEPTIDE
SCWQWGNLKICGS

SEQ ID NO: 172 - protein, 13 aa, Artificial Sequence
  CALMODULIN ANTAGONIST PEPTIDE
SCVRWGQLSICGS

SEQ ID NO: 173 - protein, 21 aa, Artificial Sequence
  CALMODULIN ANTAGONIST PEPTIDE
LKKFNARRKLKGAILTTMLAK

SEQ ID NO: 174 - protein, 18 aa, Artificial Sequence
  CALMODULIN ANTAGONIST PEPTIDE
RRWKKNFIAVSAANRFKK

SEQ ID NO: 175 - protein, 18 aa, Artificial Sequence
  CALMODULIN ANTAGONIST PEPTIDE
RKWQKTGHAVRAIGRLSS

SEQ ID NO: 176 - protein, 14 aa, Artificial Sequence
  CALMODULIN ANTAGONIST PEPTIDE
INLKALAALAKKIL

SEQ ID NO: 177 - protein, 18 aa, Artificial Sequence
  CALMODULIN ANTAGONIST PEPTIDE
KIWSILAPLGTTLVKLVA

SEQ ID NO: 178 - protein, 14 aa, Artificial Sequence
  CALMODULIN ANTAGONIST PEPTIDE
LKKLLKLLKKLLKL

SEQ ID NO: 179 - protein, 18 aa, Artificial Sequence
  CALMODULIN ANTAGONIST PEPTIDE
LKWKKLLKLLKKLLKKLL

SEQ ID NO: 180 - protein, 17 aa, Artificial Sequence
  CALMODULIN ANTAGONIST PEPTIDE
AEWPSLTEIKTLSHFSV

SEQ ID NO: 181 - protein, 17 aa, Artificial Sequence
  CALMODULIN ANTAGONIST PEPTIDE
AEWPSPTRVISTTYFGS

SEQ ID NO: 182 - protein, 17 aa, Artificial Sequence
  CALMODULIN ANTAGONIST PEPTIDE
AELAHWPPVKTVLRSFT

SEQ ID NO: 183 - protein, 17 aa, Artificial Sequence
  CALMODULIN ANTAGONIST PEPTIDE
AEGSWLQLLNLMKQMNN

SEQ ID NO: 184 - protein, 10 aa, Artificial Sequence
  CALMODULIN ANTAGONIST PEPTIDE
AEWPSLTEIK

SEQ ID NO: 185 - protein, 27 aa, Artificial Sequence
  VINCULIN-BINDING
STGGFDDVYDWARGVSSALTTTLVATR

SEQ ID NO: 186 - protein, 27 aa, Artificial Sequence
  VINCULIN-BINDING
STGGFDDVYDWARRVSSALTTTLVATR

SEQ ID NO: 187 - protein, 30 aa, Artificial Sequence
  VINCULIN-BINDING
SRGVNFSEWLYDMSAAMKEASNVFPSRRSR

SEQ ID NO: 188 - protein, 30 aa, Artificial Sequence
  VINCULIN-BINDING
SSQNWDMEAGVEDLTAAMLGLLSTIHSSSR

SEQ ID NO: 189 - protein, 31 aa, Artificial Sequence
  VINCULIN-BINDING
SSPSLYTQFLVNYESAATRIQDLLIASRPSR

SEQ ID NO: 190 - protein, 31 aa, Artificial Sequence
  VINCULIN-BINDING
SSTGWVDLLGALQRAADATRTSIPPSLQNSR

SEQ ID NO: 191 - protein, 18 aa, Artificial Sequence
  VINCULIN-BINDING
DVYTKKELIECARRVSEK

SEQ ID NO: 192 - protein, 22 aa, Artificial Sequence
  C4BP-BINDING
EKGSYYPGSGIAQFHIDYNNVS

SEQ ID NO: 193 - protein, 22 aa, Artificial Sequence
  C4BP-BINDING
SGIAQFHIDYNNVSSAEGWHVN

SEQ ID NO: 194 - protein, 34 aa, Artificial Sequence
  C4BP-BINDING
LVTVEKGSYYPGSGIAQFHIDYNNVSSAEGWHVN

SEQ ID NO: 195 - protein, 14 aa, Artificial Sequence
  C4BP-BINDING
SGIAQFHIDYNNVS

SEQ ID NO: 196 - protein, 17 aa, Artificial Sequence
  UKR ANTAGONIST PEPTIDE
AEPMPHSLNFSQYLWYT

SEQ ID NO: 197 - protein, 17 aa, Artificial Sequence
  UKR ANTAGONIST PEPTIDE
AEHTYSSLWDTYSPLAF

SEQ ID NO: 198 - protein, 17 aa, Artificial Sequence
  UKR ANTAGONIST PEPTIDE
AELDLWMRHYPLSFSNR

SEQ ID NO: 199 - protein, 17 aa, Artificial Sequence
  UKR ANTAGONIST PEPTIDE
AESSLWTRYAWPSMPSY

SEQ ID NO: 200 - protein, 17 aa, Artificial Sequence
  UKR ANTAGONIST PEPTIDE
AEWHPGLSFGSYLWSKT

SEQ ID NO: 201 - protein, 17 aa, Artificial Sequence
  UKR ANTAGONIST PEPTIDE
AEPALLNWSFFFNPGLH

SEQ ID NO: 202 - protein, 17 aa, Artificial Sequence
  UKR ANTAGONIST PEPTIDE
AEWSFYNLHLPEPQTIF

SEQ ID NO: 203 - protein, 17 aa, Artificial Sequence
  UKR ANTAGONIST PEPTIDE
AEPLDLWSLYSLPPLAM

SEQ ID NO: 204 - protein, 17 aa, Artificial Sequence
  UKR ANTAGONIST PEPTIDE
AEPTLWQLYQFPLRLSG

SEQ ID NO: 205 - protein, 17 aa, Artificial Sequence
  UKR ANTAGONIST PEPTIDE
AEISFSELMWLRSTPAF

SEQ ID NO: 206 - protein, 17 aa, Artificial Sequence
  UKR ANTAGONIST PEPTIDE
AELSEADLWTTWFGMGS

SEQ ID NO: 207 - protein, 17 aa, Artificial Sequence
  UKR ANTAGONIST PEPTIDE
AESSLWRIFSPSALMMS

SEQ ID NO: 208 - protein, 17 aa, Artificial Sequence
  UKR ANTAGONIST PEPTIDE
AESLPTLTSILWGKESV

SEQ ID NO: 209 - protein, 17 aa, Artificial Sequence
  UKR ANTAGONIST PEPTIDE
AETLFMDLWHDKHILLT

SEQ ID NO: 210 - protein, 17 aa, Artificial Sequence
  UKR ANTAGONIST PEPTIDE
AEILNFPLWHEPLWSTE

SEQ ID NO: 211 - protein, 17 aa, Artificial Sequence
  UKR ANTAGONIST PEPTIDE
AESQTGTLNTLFWNTLR

SEQ ID NO: 212 - protein, 9 aa, Artificial Sequence
  IL-1 ANTAGONIST PEPTIDE
  misc_feature (1)..(1): Xaa is V, L, I, E, P, G, Y, M, T or D.
  misc_feature (2)..(2): Xaa is Y, W or F.
  misc_feature (3)..(3): Xaa is F, W or Y.
  misc_feature (5)..(5): Xaa is P or Azetidine.
  misc_feature (7)..(7): Xaa is S, A, V or L.
  misc_feature (8)..(8): Xaa is V, L, I or E.
  misc_feature (9)..(9): Xaa is Q or P.
XXXQXYXXX

SEQ ID NO: 213 - protein, 21 aa, Artificial Sequence
  IL-1 ANTAGONIST PEPTIDE
TANVSSFEWTPYYWQPYALPL

SEQ ID NO: 214 - protein, 18 aa, Artificial Sequence
  IL-1 ANTAGONIST PEPTIDE
SWTDYGYWQPYALPISGL

SEQ ID NO: 215 - protein, 21 aa, Artificial Sequence
  IL-1 ANTAGONIST PEPTIDE
ETPFTWEESNAYYWQPYALPL

SEQ ID NO: 216 - protein, 21 aa, Artificial Sequence
  IL-1 ANTAGONIST PEPTIDE
ENTYSPNWADSMYWQPYALPL

SEQ ID NO: 217 - protein, 21 aa, Artificial Sequence
  IL-1 ANTAGONIST PEPTIDE
SVGEDHNFWTSEYWQPYALPL

SEQ ID NO: 218 - protein, 21 aa, Artificial Sequence
  IL-1 ANTAGONIST PEPTIDE
DGYDRWRQSGERYWQPYALPL

SEQ ID NO: 219 - protein, 11 aa, Artificial Sequence
  IL-1 ANTAGONIST PEPTIDE
FEWTPGYWQPY

SEQ ID NO: 220 - protein, 11 aa, Artificial Sequence
  IL-1 ANTAGONIST PEPTIDE
FEWTPGYWQHY

SEQ ID NO: 221 - protein, 11 aa, Artificial Sequence
  IL-1 ANTAGONIST PEPTIDE
  misc_feature (10)..(10): Position 10, Xaa = azetidine
FEWTPGWYQXY

SEQ ID NO: 222 - protein, 11 aa, Artificial Sequence
  IL-1 ANTAGONIST PEPTIDE
  misc_feature (1)..(1): Position 1, optionally acetlated at N terminus
  misc_feature (10)..(10): Position 10, Xaa = azetidine
FEWTPGWYQXY

SEQ ID NO: 223 - protein, 12 aa, Artificial Sequence
  IL-1 ANTAGONIST PEPTIDE
  misc_feature (11)..(11): Position 11, Xaa = azetidine
FEWTPGWPYQXY

SEQ ID NO: 224 - protein, 11 aa, Artificial Sequence
  IL-1 ANTAGONIST PEPTIDE
  misc_feature (10)..(10): Position 10, Xaa = azetidine
FAWTPGYWQXY

SEQ ID NO: 225 - protein, 11 aa, Artificial Sequence
  IL-1 ANTAGONIST PEPTIDE
  misc_feature (10)..(10): Position 10, Xaa = azetidine
FEWAPGYWQXY

SEQ ID NO: 226 - protein, 11 aa, Artificial Sequence
  IL-1 ANTAGONIST PEPTIDE
  misc_feature (10)..(10): Position 10, Xaa = azetidine
FEWVPGYWQXY

SEQ ID NO: 227 - protein, 11 aa, Artificial Sequence
  IL-1 ANTAGONIST PEPTIDE
  misc_feature (10)..(10): Position 10, Xaa = azetidine
FEWTPGYWQXY

SEQ ID NO: 228 - protein, 11 aa, Artificial Sequence
  IL-1 ANTAGONIST PEPTIDE
  misc_feature (1)..(1): Position 1, optionally acetylated at N terminus
  misc_feature (10)..(10): Position 10, Xaa = azetidine
FEWTPGYWQXY

SEQ ID NO: 229 - protein, 11 aa, Artificial Sequence
  IL-1 ANTAGONIST PEPTIDE
  misc_feature (6 )..(6): Position 6, Xaa products = "MeGly"
  misc_feature (10)..(10): Position 10, Xaa = azetidine
FEWTPXWYQXY

SEQ ID NO: 230 - protein, 11 aa, Artificial Sequence
  IL-1 ANTAGONIST PEPTIDE
  misc_feature (6)..(6): Position 6, Xaa = MeGly
  misc_feature (10)..(10): Position 10, Xaa = azetidine
FEWTPXWYQXY

SEQ ID NO: 231 - protein, 11 aa, Artificial Sequence
  IL-1 ANTAGONIST PEPTIDE
FEWTPGYYQPY

SEQ ID NO: 232 - protein, 11 aa, Artificial Sequence
  IL-1 ANTAGONIST PEPTIDE
FEWTPGWWQPY

SEQ ID NO: 233 - protein, 11 aa, Artificial Sequence
  IL-1 ANTAGONIST PEPTIDE
FEWTPNYWQPY

SEQ ID NO: 234 - protein, 11 aa, Artificial Sequence
  IL-1 ANTAGONIST PEPTIDE
  misc_feature (5)..(5): Position 5, Xaa = pipecolic acid
  misc_feature (10)..(10): Position 10, Xaa = azetidine
FEWTXVYWQXY

SEQ ID NO: 235 - protein, 11 aa, Artificial Sequence
  IL-1 ANTAGONIST PEPTIDE
  misc_feature (5)..(5): Position 5, Xaa = pipecolic acid
  misc_feature (10)..(10): Position 10, Xaa = azetidine
FEWTXGYWQXY

SEQ ID NO: 236 - protein, 11 aa, Artificial Sequence
  IL-1 ANTAGONIST PEPTIDE
  misc_feature (6 )..(6): Position 6, Xaa = Aib
  misc_feature (10)..(10): Position 10, Xaa = azetidine
FEWTPXYWQXY

SEQ ID NO: 237 - protein, 11 aa, Artificial Sequence
  IL-1 ANTAGONIST PEPTIDE
  misc_feature (5 )..(5): Position 5, Xaa = MeGly
  misc_feature (10)..(10): Position 10, Xaa = azetidine
FEWTXGYWQXY

SEQ ID NO: 238 - protein, 11 aa, Artificial Sequence
  IL-1 ANTAGONIST PEPTIDE
  misc_feature (11)..(11): Position 11, amino group added at C terminus
FEWTPGYWQPY

SEQ ID NO: 239 - protein, 11 aa, Artificial Sequence
  IL-1 ANTAGONIST PEPTIDE
  misc_feature (11)..(11): Position 11, amino group added at C-terminus
FEWTPGYWQHY

SEQ ID NO: 240 - protein, 11 aa, Artificial Sequence
  IL-1 ANTAGONIST PEPTIDE
  misc_feature (10)..(10): Position 10, Xaa is an azetidine residue Position 11 amino group added at C-terminus
  misc_feature (11)..(11): Position 11 amino group added at C-terminus
FEWTPGWYQXY

SEQ ID NO: 241 - protein, 11 aa, Artificial Sequence
  IL-1 ANTAGONIST PEPTIDE
  misc_feature (1)..(1): Position 1 optionally acetylated at N-terminus
  misc_feature (10)..(10): Position 10, Xaa is an azetidine residue
  misc_feature (11)..(11): Position 11 amino group added at C-terminus
FEWTPGWYQXY

SEQ ID NO: 242 - protein, 11 aa, Artificial Sequence
  IL-1 ANTAGONIST PEPTIDE
  misc_feature (8)..(8): Position 8, Xaa is a phyosphotyrosyl residue
  misc_feature (10)..(10): Position 10, Xaa is an azetidine residue
  misc_feature (11)..(11): Position 11 amino group added at C-terminus
FEWTPGWXQXY

SEQ ID NO: 243 - protein, 11 aa, Artificial Sequence
  IL-1 ANTAGONIST PEPTIDE
  misc_feature (10)..(10): Position 10, Xaa is an azetidine residue
  misc_feature (11)..(11): Position 11 amino group added at C-terminus
FAWTPGYWQXY

SEQ ID NO: 244 - protein, 11 aa, Artificial Sequence
  IL-1 ANTAGONIST PEPTIDE
  misc_feature (10)..(10): Position 10, Xaa is an azetidine residue
  misc_feature (11)..(11): Position 11 amino group added at C-terminus
FEWAPGYWQXY

SEQ ID NO: 245 - protein, 11 aa, Artificial Sequence
  IL-1 ANTAGONIST PEPTIDE
  misc_feature (10)..(10): Position 10, Xaa is an azetidine residue
  misc_feature (11)..(11): Position 11 amino group added at C-terminus
FEWVPGYWQXY

SEQ ID NO: 246 - protein, 11 aa, Artificial Sequence
  IL-1 ANTAGONIST PEPTIDE
  misc_feature (10)..(10): Position 10, Xaa is an azetidine residue
  misc_feature (11)..(11): Position 11 amino group added at C-terminus
FEWTPGYWQXY

SEQ ID NO: 247 - protein, 11 aa, Artificial Sequence
  IL-1 ANTAGONIST PEPTIDE
  misc_feature (1)..(1): Position 1 acetylated at N-terminus
  misc_feature (10)..(10): Position 10, Xaa is an azetidine residue
  misc_feature (11)..(11): Position 11 amino group added at C-terminus
FEWTPGYWQXY

SEQ ID NO: 248 - protein, 11 aa, Artificial Sequence
  IL-1 ANTAGONIST PEPTIDE
  misc_feature (6)..(6): Position 6, D amino acid residue
  misc_feature (10)..(10): Position 10, Xaa is an azetidine residue
  misc_feature (11)..(11): Position 11 amino group added at C-terminus
FEWTPAWYQXY

SEQ ID NO: 249 - protein, 11 aa, Artificial Sequence
  IL-1 ANTAGONIST PEPTIDE
  misc_feature (6)..(6): Position 6, Xaa is a sarcosine residue
  misc_feature (10)..(10): Position 10, Xaa is an azetidine residue
  misc_feature (11)..(11): Position 11 amino group added at C-terminus
FEWTPXWYQXY

SEQ ID NO: 250 - protein, 11 aa, Artificial Sequence
  IL-1 ANTAGONIST PEPTIDE
  misc_feature (11)..(11): Position 11 amino group added at C-terminus
FEWTPGYYQPY

SEQ ID NO: 251 - protein, 11 aa, Artificial Sequence
  IL-1 ANTAGONIST PEPTIDE
  misc_feature (11)..(11): Position 11 amino group added at C-terminus
FEWTPGWWQPY

SEQ ID NO: 252 - protein, 11 aa, Artificial Sequence
  IL-1 ANTAGONIST PEPTIDE
  misc_feature (11)..(11): Position 11 amino group added at C-terminus
FEWTPNYWQPY

SEQ ID NO: 253 - protein, 11 aa, Artificial Sequence
  IL-1 ANTAGONIST PEPTIDE
  misc_feature (6)..(6): Position 6, D amino acid residue
  misc_feature (10)..(10): Position 10, Xaa is an azetidine residue
  misc_feature (11)..(11): Position 11 amino group added at C-terminus
FEWTPVYWQXY

SEQ ID NO: 254 - protein, 11 aa, Artificial Sequence
  IL-1 ANTAGONIST PEPTIDE
  misc_feature (5)..(5): Position 5, Xaa is a pipecolic acid residue
  misc_feature (10)..(10): Position 10, Xaa is an azetidine residue
  misc_feature (11)..(11): Position 11 amino group added at C-terminus
FEWTXGYWQXY

SEQ ID NO: 255 - protein, 11 aa, Artificial Sequence
  IL-1 ANTAGONIST PEPTIDE
  misc_feature (6)..(6): Position 6, Xaa = pipecolic acid
  misc_feature (10)..(10): Position 10, Xaa = azetidine
FEWTPXYWQXY

SEQ ID NO: 256 - protein, 11 aa, Artificial Sequence
  IL-1 ANTAGONIST PEPTIDE
  misc_feature (5)..(5): Position 5, Xaa = MeGly
  misc_feature (10)..(10): Position 10, Xaa = azetidine
FEWTXGYWQXY

SEQ ID NO: 257 - protein, 15 aa, Artificial Sequence
  IL-1 ANTAGONIST PEPTIDE
FEWTPGYWQPYALPL

SEQ ID NO: 258 - protein, 11 aa, Artificial Sequence
  IL-1 ANTAGONIST PEPTIDE
  misc_feature (1)..(1): Position 1, Xaa is a 1-naphthylalanine residue
  misc_feature (10)..(10): Position 10, Xaa is an azetidine residue
  misc_feature (11)..(11): Position 11 amino group added at C-terminus
XEWTPGYYQXY

SEQ ID NO: 259 - protein, 11 aa, Artificial Sequence
  IL-1 ANTAGONIST PEPTIDE
  misc_feature (10)..(10): Position 10, Xaa is an azetidine residue
  misc_feature (11)..(11): Position 11 amino group added at C-terminus
YEWTPGYYQXY

SEQ ID NO: 260 - protein, 11 aa, Artificial Sequence
  IL-1 ANTAGONIST PEPTIDE
  misc_feature (10)..(10): Position 10, Xaa is an azetidine residue
  misc_feature (11)..(11): Position 11 amino group added at C-terminus
FEWVPGYYQXY

SEQ ID NO: 261 - protein, 11 aa, Artificial Sequence
  IL-1 ANTAGONIST PEPTIDE
  misc_feature (6)..(6): Position 6, D amino acid residue
  misc_feature (10)..(10): Position 10, Xaa is an azetidine residue
  misc_feature (11)..(11): Position 11 amino group added at C-terminus
FEWTPSYYQXY

SEQ ID NO: 262 - protein, 11 aa, Artificial Sequence
  IL-1 ANTAGONIST PEPTIDE
  misc_feature (6)..(6): Position 6, D amino acid residue
  misc_feature (10)..(10): Position 10, Xaa is an azetidine residue
  misc_feature (11)..(11): Position 11 amino group added at C-terminus
FEWTPNYYQXY

SEQ ID NO: 263 - protein, 4 aa, Artificial Sequence
  IL-1 ANTAGONIST PEPTIDE
TKPR

SEQ ID NO: 264 - protein, 5 aa, Artificial Sequence
  IL-1 ANTAGONIST PEPTIDE
RKSSK

SEQ ID NO: 265 - protein, 5 aa, Artificial Sequence
  IL-1 ANTAGONIST PEPTIDE
RKQDK

SEQ ID NO: 266 - protein, 6 aa, Artificial Sequence
  IL-1 ANTAGONIST PEPTIDE
NRKQDK

SEQ ID NO: 267 - protein, 6 aa, Artificial Sequence
  IL-1 ANTAGONIST PEPTIDE
RKQDKR

SEQ ID NO: 268 - protein, 9 aa, Artificial Sequence
  IL-1 ANTAGONIST PEPTIDE
ENRKQDKRF

SEQ ID NO: 269 - protein, 6 aa, Artificial Sequence
  IL-1 ANTAGONIST PEPTIDE
VTKFYF

SEQ ID NO: 270 - protein, 5 aa, Artificial Sequence
  IL-1 ANTAGONIST PEPTIDE
VTKFY

SEQ ID NO: 271 - protein, 5 aa, Artificial Sequence
  IL-1 ANTAGONIST PEPTIDE
VTDFY

SEQ ID NO: 272 - protein, 17 aa, Artificial Sequence
  MAST CELL ANTAGONISTS/ PROTEASE INHIBITOR PEPTIDE
SGSGVLKRPLPILPVTR

SEQ ID NO: 273 - protein, 17 aa, Artificial SEquence
  MAST CELL ANTAGONISTS/ PROTEASE INHIBITOR PEPTIDE
RWLSSRPLPPLPLPPRT

SEQ ID NO: 274 - protein, 20 aa, Artificial Sequence
  MAST CELL ANTAGONISTS/ PROTEASE INHIBITOR PEPTIDE
GSGSYDTLALPSLPLHPMSS

SEQ ID NO: 275 - protein, 20 aa, Artificial Sequence
  MAST CELL ANTAGONISTS/ PROTEASE INHIBITOR PEPTIDE
GSGSYDTRALPSLPLHPMSS

SEQ ID NO: 276 - protein, 20 aa, Artificial Sequence
  MAST CELL ANTAGONISTS/ PROTEASE INHIBITOR PEPTIDE
GSGSSGVTMYPKLPPHWSMA

SEQ ID NO: 277 - protein, 20 aa, Artificial Sequence
  MAST CELL ANTAGONISTS/ PROTEASE INHIBITOR PEPTIDE
GSGSSGVRMYPKLPPHWSMA

SEQ ID NO: 278 - protein, 20 aa, Artificial Sequence
  MAST CELL ANTAGONISTS/ PROTEASE INHIBITOR PEPTIDE
GSGSSSMRMVPTIPGSAKHG

SEQ ID NO: 279 - protein, 6 aa, Artificial Sequence
  ANTI-HBV
LLGRMK

SEQ ID NO: 280 - protein, 8 aa, Artificial Sequence
  ANTI-HBV
ALLGRMKG

SEQ ID NO: 281 - protein, 6 aa, Artificial Sequence
  ANTI-HBV
LDPAFR

SEQ ID NO: 282 - protein, 7 aa, Artificial Sequence
  SH3 ANTAGONIST PEPTIDE
RPLPPLP

SEQ ID NO: 283 - protein, 7 aa, Artificial Sequence
  SH3 ANTAGONIST PEPTIDE
RELPPLP

SEQ ID NO: 284 - protein, 7 aa, Artificial Sequence
  SH3 ANTAGONIST PEPTIDE
SPLPPLP

SEQ ID NO: 285 - protein, 7 aa, Artificial Sequence
  SH3 ANTAGONIST PEPTIDE
GPLPPLP

SEQ ID NO: 286 - protein, 7 aa, Artificial Sequence
  SH3 ANTAGONIST PEPTIDE
RPLPIPP

SEQ ID NO: 287 - protein, 7 aa, Artificial Sequence
  SH3 ANTAGONIST PEPTIDE
RPLPIPP

SEQ ID NO: 288 - protein, 7 aa, Artificial Sequence
  SH3 ANTAGONIST PEPTIDE
RRLPPTP

SEQ ID NO: 289 - protein, 7 aa, Artificial Sequence
  SH3 ANTAGONIST PEPTIDE
RQLPPTP

SEQ ID NO: 290 - protein, 7 aa, Artificial Sequence
  SH3 ANTAGONIST PEPTIDE
RPLPSRP

SEQ ID NO: 291 - protein, 7 aa, Artificial Sequence
  SH3 ANTAGONIST PEPTIDE
RPLPTRP

SEQ ID NO: 292 - protein, 7 aa, Artificial Sequence
  SH3 ANTAGONIST PEPTIDE
SRLPPLP

SEQ ID NO: 293 - protein, 7 aa, Artificial Sequence
  SH3 ANTAGONIST PEPTIDE
RALPSPP

SEQ ID NO: 294 - protein, 7 aa, Artificial Sequence
  SH3 ANTAGONIST PEPTIDE
RRLPRTP

SEQ ID NO: 295 - protein, 7 aa, Artificial Sequence
  SH3 ANTAGONIST PEPTIDE
RPVPPIT

SEQ ID NO: 296 - protein, 7 aa, Artificial Sequence
  SH3 ANTAGONIST PEPTIDE
ILAPPVP

SEQ ID NO: 297 - protein, 7 aa, Artificial Sequence
  SH3 ANTAGONIST PEPTIDE
RPLPMLP

SEQ ID NO: 298 - protein, 7 aa, Artificial Sequence
  SH3 ANTAGONIST PEPTIDE
RPLPILP

SEQ ID NO: 299 - protein, 7 aa, Artificial Sequence
  SH3 ANTAGONIST PEPTIDE
RPLPSLP

SEQ ID NO: 300 - protein, 7 aa, Artificial Sequence
  SH3 ANTAGONIST PEPTIDE
RPLPSLP

SEQ ID NO: 301 - protein, 7 aa, Artificial Sequence
  SH3 ANTAGONIST PEPTIDE
RPLPMIP

SEQ ID NO: 302 - protein, 7 aa, Artificial Sequence
  SH3 ANTAGONIST PEPTIDE
RPLPLIP

SEQ ID NO: 303 - protein, 7 aa, Artificial Sequence
  SH3 ANTAGONIST PEPTIDE
RPLPPTP

SEQ ID NO: 304 - protein, 7 aa, Artificial Sequence
  SH3 ANTAGONIST PEPTIDE
RSLPPLP

SEQ ID NO: 305 - protein, 7 aa, Artificial Sequence
  SH3 ANTAGONIST PEPTIDE
RPQPPPP

SEQ ID NO: 306 - protein, 7 aa, Artificial Sequence
  SH3 ANTAGONIST PEPTIDE
RQLPIPP

SEQ ID NO: 307 - protein, 12 aa, Artificial Sequence
  SH3 ANTAGONIST PEPTIDE
  misc_feature (1, 2, 3)..(11): Xaa = any amino acid
XXXRPLPPLPXP

SEQ ID NO: 308 - protein, 12 aa, Artificial Sequence
  SH3 ANTAGONIST PEPTIDE
  misc_feature (1, 2, 3, 11)..(12): Xaa = any amino acid
XXXRPLPPIPXX

SEQ ID NO: 309 - protein, 12 aa, Artificial Sequence
  SH3 ANTAGONIST PEPTIDE
  misc_feature (1, 2, 3, 11,)..(12): Xaa = any amino acid
XXXRPLPPLPXX

SEQ ID NO: 310 - protein, 12 aa, Artificial Sequence
  SH3 ANTAGONIST PEPTIDE
  misc_feature (2, 3, 10)..(11): Xaa = any amino acid
RXXRPLPPLPXP

SEQ ID NO: 311 - protein, 12 aa, Artificial Sequence
  SH3 ANTAGONIST PEPTIDE
  misc_feature (2)..(3): Xaa = any amino acid
RXXRPLPPLPPP

SEQ ID NO: 312 - protein, 12 aa, Artificial Sequence
  SH3 ANTAGONIST PEPTIDE
  misc_feature (11)..(12): Xaa = any amino acid
PPPYPPPPIPXX

SEQ ID NO: 313 - protein, 12 aa, Artificial Sequence
  SH3 ANTAGONIST PEPTIDE
  misc_feature (11)..(12): Xaa = any amino acid
PPPYPPPPVPXX

SEQ ID NO: 314 - protein, 10 aa, Artificial Sequence
  SH3 ANTAGONIST PEPTIDE
  misc_feature (2, 3)..(8): Xaa (Pos2, 3, 8) is any amino acid
  misc_feature (9)..(9): Xaa (Pos 9) represents an aliphatic amino acid residue
LXXRPLPXXP

SEQ ID NO: 315 - protein, 10 aa, Artificial Sequence
  SH3 ANTAGONIST PEPTIDE
  misc_feature (1)..(1): Position 1, Xaa is an aliphatic amino acid residue
  misc_feature (2, 3)..(8): Positions 2, 3 & 8, Xaa is any amino acid
XXXRPLPXLP

SEQ ID NO: 316 - protein, 10 aa, Artificial Sequence
  SH3 ANTAGONIST PEPTIDE
  misc_feature (3)..(3): Position 3, Xaa is any amino acid residue
  misc_feature (4)..(4): Position 4, Xaa is an aromatic amino acid residue
  misc_feature (9)..(9): Position 9, Xaa is an aliphatic amino acid residue
PPXXYPPPXP

SEQ ID NO: 317 - protein, 11 aa, Artificial Sequence
  SH3 ANTAGONIST PEPTIDE
  misc_feature (1)..(1): Position 1, Xaa is a basic amino acid residue
  misc_feature (4)..(4): Position 4, Xaa is an aliphatic amino acid residue
  misc_feature (6)..(9): Positions 6 & 9, Xaa is any amino acid residue
XPPXPXKPXWL

SEQ ID NO: 318 - protein, 11 aa, Artificial Sequence
  SH3 ANTAGONIST PEPTIDE
  misc_feature (3, 4)..(6): Positions 3, 4 & 6, Xaa is an aliphatic amino acid residue
  misc_feature (8)..(8): Position 8, Xaa is a basic amino acid residue
  misc_feature (10)..(10): Position 10, Xaa is any amino acid residue
RPXXPXRXSXP

SEQ ID NO: 319 - protein, 11 aa, Artificial Sequence
  SH3 ANTAGONIST PEPTIDE
  misc_feature (8)..(9): Xaa = any amino acid
PPVPPRPXXTL

SEQ ID NO: 320 - protein, 7 aa, Artificial Sequence
  SH3 ANTAGONIST PEPTIDE
  misc_feature (1, 3)..(6): Positions 1, 3 and 6, Xaa is an aliphatic amino acid residue
XPXLPXK

SEQ ID NO: 321 - protein, 10 aa, Artificial Sequence
  SH3 ANTAGONIST PEPTIDE
  misc_feature (1)..(1): Position 1, Xaa is a basic amino acid residue
  misc_feature (2)..(2): Position 2, Xaa is an aromatic amino acid residue
  misc_feature (4)..(8): Positions 4 & 8, Xaa is any amino acid residue
XXDXPLPXLP

SEQ ID NO: 322 - protein, 7 aa, Artificial Sequence
  INHIBITION OF PLATELET AGGREGATION
  misc_feature (2)..(3): Xaa = any amino acid
CXXRGDC

SEQ ID NO: 323 - protein, 7 aa, Artificial Sequence
  SRC ANTAGONIST
RPLPPLP

SEQ ID NO: 324 - protein, 6 aa, Artificial Sequence
  SRC ANTAGONIST
PPVPPR

SEQ ID NO: 325 - protein, 11 aa, Artificial Sequence
  ANTI-CANCER (PARTICULARLY FOR SARCOMAS)
  misc_feature (1, 3, 5, 7, 8, 10)..(11): Xaa = any amino acid
XFXDXWXXLXX

SEQ ID NO: 326 - protein, 20 aa, Artificial Sequence
  P16-MIMETIC
KACRRLFGPVDSEQLSRDCD

SEQ ID NO: 327 - protein, 20 aa, Artificial Sequence
  P16-MIMETIC
RERWNFDFVTETPLEGDFAW

SEQ ID NO: 328 - protein, 20 aa, Artificial Sequence
  P16-MIMETIC
KRRQTSMTDFYHSKRRLIFS

SEQ ID NO: 329 - protein, 20 aa, Artificial Sequence
  P16-MIMETIC
TSMTDFYHSKRRLIFSKRKP

SEQ ID NO: 330 - protein, 5 aa, Artificial Sequence
  P16-MIMETIC
RRLIF

SEQ ID NO: 331 - protein, 36 aa, Artificial Sequence [sequence omitted]

SEQ ID NO: 332 - protein, 24 aa, Artificial Sequence
  P16-MIMETIC
KRRLIFSKRQIKIWFQNRRMKWKK

SEQ ID NO: 333 - protein, 8 aa, Artificial Sequence
  PREFERRED LINKER
GGGKGGGG

SEQ ID NO: 334 - protein, 8 aa, Artificial Sequence
  PREFERRED LINKER
GGGNGSGG

SEQ ID NO: 335 - protein, 8 aa, Artificial Sequence
  PREFERRED LINKER
GGGCGGGG

SEQ ID NO: 336 - protein, 5 aa, Artificial Sequence
  PREFERRED LINKER
GPNGG

SEQ ID NO: 337 - protein, 41 aa, Artificial Sequence
  TPO-MIMETIC
  misc_feature (1)..(1): Fc domain attached at Position 1 of the N-terminus
GGGGGIEGPTLRQWLAARAGGGGGGGGIEGPTLRQWLAARA

SEQ ID NO: 338 - protein, 41 aa, Artificial Sequence
  TPO-MIMETIC
  misc_feature (41)..(41): Fc domain attached at Position 41 of the C-terminus
IEGPTLRQWLAARAGGGGGGGGIEGPTLRQWLAARAGGGGG

SEQ ID NO: 339 - protein, 49 aa, Artificial Sequence
  EPO-MIMETIC
  misc_feature (1)..(1): Fc domain attached at Position 1 of the N-terminus
GGGGGGGTYSCHFGPLTWVCKPQGGGGGGGGTYSCHFGPLTWVCKPQGG

SEQ ID NO: 340 - protein, 49 aa, Artificial Sequence
  EPO-MIMETIC
  misc_feature (49)..(49): Fc domain attached at Position 49 of the C-terminus
GGTYSCHFGPLTWVCKPQGGGGGGGGTYSCHFGPLTWVCKPQGGGGGGG

SEQ ID NO: 341 - protein, 28 aa, Artificial Sequence
  TPO-MIMETIC PEPTIDES
IEGPTLRQWLAARAIEGPTLRQWLAARA

SEQ ID NO: 342 - protein, 29 aa, Artificial Sequence
  TPO-MIMETIC PEPTIDES
IEGPTLRQWLAARAGIEGPTLRQWLAARA

SEQ ID NO: 343 - protein, 30 aa, Artificial Sequence
  TPO-MIMETIC PEPTIDES
IEGPTLRQWLAARAGGIEGPTLRQWLAARA

SEQ ID NO: 344 - protein, 31 aa, Artificial Sequence
  TPO-MIMETIC PEPTIDES
IEGPTLRQWLAARAGGGIEGPTLRQWLAARA

SEQ ID NO: 345 - protein, 32 aa, Artificial Sequence
  TPO-MIMETIC PEPTIDES
IEGPTLRQWLAARAGGGGIEGPTLRQWLAARA

SEQ ID NO: 346 - protein, 33 aa, Artificial Sequence
  TPO-MIMETIC PEPTIDES
IEGPTLRQWLAARAGGGGGIEGPTLRQWLAARA

SEQ ID NO: 347 - protein, 34 aa, Artificial Sequence
  TPO-MIMETIC PEPTIDES
IEGPTLRQWLAARAGGGGGGIEGPTLRQWLAARA

SEQ ID NO: 348 - protein, 35 aa, Artificial Sequence
  TPO-MIMETIC PEPTIDES
IEGPTLRQWLAARAGGGGGGGIEGPTLRQWLAARA

SEQ ID NO: 349 - protein, 36 aa, Artificial Sequence; identical to SEQ ID NO: 14
  TPO-MIMETIC PEPTIDES

SEQ ID NO: 350 - protein, 37 aa, Artificial Sequence
  TPO-MIMETIC PEPTIDES
IEGPTLRQWLAARAGGGGGGGGGIEGPTLRQWLAARA

SEQ ID NO: 351 - protein, 38 aa, Artificial Sequence
  TPO-MIMETIC PEPTIDES
IEGPTLRQWLAARAGGGGGGGGGGIEGPTLRQWLAARA

SEQ ID NO: 352 - protein, 42 aa, Artificial Sequence
  TPO-MIMETIC PEPTIDES
IEGPTLRQWLAARAGGGGGGGGGGGGGGIEGPTLRQWLAARA

SEQ ID NO: 353 - protein, 32 aa, Artificial Sequence
  TPO-MIMETIC PEPTIDES
IEGPTLRQWLAARAGPNGIEGPTLRQWLAARA

SEQ ID NO: 354 - protein, 36 aa, Artificial Sequence; identical to SEQ ID NO: 14
  TPO-MIMETIC PEPTIDES

SEQ ID NO: 355 - protein, 36 aa, Artificial Sequence; identical to SEQ ID NO: 14
  TPO-MIMETIC PEPTIDES

SEQ ID NO: 356 - protein, 36 aa, Artificial Sequence; identical to SEQ ID NO: 14
  TPO-MIMETIC PEPTIDES

SEQ ID NO: 357 - protein, 36 aa, Artificial Sequence; identical to SEQ ID NO: 3
  TPO-MIMETIC PEPTIDES

SEQ ID NO: 358 - protein, 37 aa, Artificial Sequence
  TPO-MIMETIC PEPTIDES
  misc_feature (19)..(19): Position 19, Xaa = bromoacetyl
IEGPTLRQWLAARAGGGKXGGGGIEGPTLRQWLAARA

SEQ ID NO: 359 - protein, 36 aa, Artificial Sequence; identical to SEQ ID NO: 4
  TPO-MIMETIC PEPTIDES

SEQ ID NO: 360 - protein, 37 aa, Artificial Sequence; identical to SEQ ID NO: 358
  TPO-MIMETIC PEPTIDES
  misc_feature (19)..(19): Position 19, Xaa = Poly(ethylene glycol)

SEQ ID NO: 361 - protein, 37 aa, Artificial Sequence
  TPO-MIMETIC PEPTIDES
  misc_feature (19)..(19): Position 19, Xaa = Poly(ethylene glycol)
IEGPTLRQWLAARAGGGCXGGGGIEGPTLRQWLAARA

SEQ ID NO: 362 - protein, 36 aa, Artificial Sequence
  TPO-MIMETIC PEPTIDES
IEGPTLRQWLAARAGGGNGSGGIEGPTLRQWLAARA

SEQ ID NO: 363 - protein, 36 aa, Artificial Sequence; identical to SEQ ID NO: 4
  TPO-MIMETIC PEPTIDES

SEQ ID NO: 364 - DNA, 57 bp, Artificial Sequence
  Fc-TMP
aaaaaaggatcctcgagattaagcacgagcagccagccactgacgcagagtcggacc

SEQ ID NO: 365 - DNA, 39 bp, Artificial Sequence
  Fc-TMP
aaaggtggaggtggtggtatcgaaggtccgactctgcgt

SEQ ID NO: 366 - DNA, 42 bp, Artificial Sequence
  Fc-TMP
cagtggctggctgctcgtgcttaatctcgaggatcctttttt

SEQ ID NO: 367 - DNA, 81 bp, Artificial Sequence
  Fc-TMP
  CDS (1)..(60)
aaaggtggaggtggtggtatcgaaggtccgactctgcgtcagtggctggctgctcgtgcttaatctcgaggatcctttttt

SEQ ID NO: 368 - protein, 20 aa, Artificial Sequence
  Fc-TMP
KGGGGGIEGPTLRQWLAARA

SEQ ID NO: 369 - DNA, 22 bp, Artificial Sequence
  Fc-TMP
aacataagtacctgtaggatcg

SEQ ID NO: 370 - DNA, 52 bp, Artificial Sequence
  Fc-TMP
ttcgataccaccacctccacctttacccggagacagggagaggctcttctgc

SEQ ID NO: 371 - DNA, 60 bp, Artificial Sequence
  Fc-TMP-TMP
aaaggtggaggtggtggtatcgaaggtccgactctgcgtcagtggctggctgctcgtgct

SEQ ID NO: 372 - DNA, 48 bp, Artificial Sequence
  Fc-TMP-TMP
acctccaccaccagcacgagcagccagccactgacgcagagtcggacc

SEQ ID NO: 373 - DNA, 66 bp, Artificial Sequence
  Fc-TMP-TMP
ggtggtggaggtggcggcggaggtattgagggcccaacccttcgccaatggcttgcagcacgcgca

SEQ ID NO: 374 - protein, 76 aa, Artificial Sequence
  Fc-TMP-TMP
AAAAAAAGGATCCTCGAGATTATGCGCGTGCTGCAAGCCATTGGCGAAGGGTTGGGCCCTCAATACCTCCGCCGCC

SEQ ID NO: 375 - DNA, 126 bp, Artificial Sequence
  Fc-TMP-TMP
  CDS (1)..(126)
aaaggtggaggtggtggtatcgaaggtccgactctgcgtcagtggctggctgctcgtgctggtggtggaggtggcggcggaggtattgagggcccaacccttcgccaatggcttgcagcacgcgca

SEQ ID NO: 376 - protein, 42 aa, Artificial Sequence
  Fc-TMP-TMP
KGGGGGIEGPTLRQWLAARAGGGGGGGGIEGPTLRQWLAARA

SEQ ID NO: 377 - protein, 39 aa, Artificial Sequence
  TMP-TMP-Fc
TTTTTTCATATGATCGAAGGTCCGACTCTGCGTCAGTGG

SEQ ID NO: 378 - protein, 48 aa, Artificial Sequence
  TMP-TMP-Fc
AGCACGAGCAGCCAGCCACTGACGCAGAGTCGGACCTTCGATCATATG

SEQ ID NO: 379 - DNA, 45 bp, Artificial Sequence
  TMP-TMP-Fc
ctggctgctcgtgctggtggaggcggtggggacaaaactcacaca

SEQ ID NO: 380 - DNA, 51 bp, Artificial Sequence
  TMP-TMP-Fc
ctggctgctcgtgctggcggtggtggcggagggggtggcattgagggccca

SEQ ID NO: 381 - DNA, 54 bp, Artificial Sequence
  TMP-TMP-Fc
aagccattggcgaagggttgggccctcaatgccaccccctccgccaccaccgcc

SEQ ID NO: 382 - DNA, 54 bp, Artificial Sequence
  TMP-TMP-Fc
acccttcgccaatggcttgcagcacgcgcagggggaggcggtggggacaaaact

SEQ ID NO: 383 - DNA, 27 bp, Artificial Sequence
  TMP-TMP-Fc
cccaccgcctccccctgcgcgtgctgc

SEQ ID NO: 384 - DNA, 189 bp, Artificial Sequence
  TMP-TMP-Fc
  CDS (10)..(180)
ttttttcatatgatcgaaggtccgactctgcgtcagtggctggctgctcgtgctggcggtggtggcggagggggtggcattgagggcccaacccttcgccaatggctggctgctcgtgctggtggaggcggtggggacaaaactctggctgctcgtgctggtggaggcggtggggacaaaactcacaca

SEQ ID NO: 385 - protein, 57 aa, Artificial Sequence
  TMP-TMP-Fc
MIEGPTLRQWLAARAGGGGGGGGIEGPTLRQWLAARAGGGGGDKTLAARAGGGGGDK

SEQ ID NO: 386 - DNA, 141 bp, Artificial Sequence
  pAMG21
ctaattccgctctcacctaccaaacaatgcccccctgcaaaaaataaattcatataaaaaacatacagataaccatctgcggtgataaattatctctggcggtgttgacataaataccactggcggtgatactgagcacat

SEQ ID NO: 387 - DNA, 55 bp, Artificial Sequence
  pAMG21
cgatttgattctagaaggaggaataacatatggttaacgcgttggaattcggtac

SEQ ID NO: 388 - DNA, 872 bp, Artificial Sequence
  GM221
ttattttcgtgcggccgcaccattatcaccgccagaggtaaactagtcaacacgcacggtgttagatatttatcccttgcggtgatagattgagcacatcgatttgattctagaaggagggataatatatgagcacaaaaaagaaaccattaacacaagagcagcttgaggacgcacgtcgccttaaagcaatttatgaaaaaaagaaaaatgaacttggcttatcccaggaatctgtcgcagacaagatggggatggggcagtcaggcgttggtgctttatttaatggcatcaatgcattaaatgcttataacgccgcattgcttacaaaaattctcaaagttagcgttgaagaatttagcccttcaatcgccagagaatctacgagatgtatgaagcggttagtatgcagccgtcacttagaagtgagtatgagtaccctgttttttctcatgttcaggcagggatgttctcacctaagcttagaacctttaccaaaggtgatgcggagagatgggtaagcacaaccaaaaaagccagtgattctgcattctggcttgaggttgaaggtaattccatgaccgcaccaacaggctccaagccaagctttcctgacggaatgttaattctcgttgaccctgagcaggctgttgagccaggtgatttctgcatagccagacttgggggtgatgagtttaccttcaagaaactgatcagggatagcggtcaggtgtttttacaaccactaaacccacagtacccaatgatcccatgcaatgagagttgttccgttgtggggaaagttatcgctagtcagtggcctgaagagacgtttggctgatagactagtggatccactagtgtttctgccc

SEQ ID NO: 389 - DNA, 1197 bp, Artificial Sequence
  GM221
ggcggaaaccgacgtccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtcgaagcggcgatggcggagctgaattacattcccaaccgcgtggcacaacaactggcgggcaaacagtcgctcctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcggacagtaaggtaccataggatccaggcacagga

SEQ ID NO: 390 - DNA, 61 bp, Artificial Sequence
  Fc-EMP
tatgaaaggtggaggtggtggtggaggtacttactcttgccacttcggcccgctgacttgg

SEQ ID NO: 391 - DNA, 72 bp, Artificial Sequence
  Fc-EMP
cggtttgcaaacccaagtcagcgggccgaagtggcaagagtaagtacctccaccaccacctccacctttcat

SEQ ID NO: 392 - DNA, 57 bp, Artificial Sequence
  Fc-EMP
gtttgcaaaccgcagggtggcggcggcggcggcggtggtacctattcctgtcatttt

SEQ ID NO: 393 - DNA, 60 bp, Artificial Sequence
  Fc-EMP
ccaggtcagcgggccaaaatgacaggaataggtaccaccgccgccgccgccgccaccctg

SEQ ID NO: 394 - DNA, 118 bp, Artificial Sequence
  Fc-EMP
  CDS (2)..(118)
tatgaaaggtggaggtggtggtggaggtacttactcttgccacttcggcccgctgacttgggtttgcaaaccgcagggtggcggcggcggcggcggtggtacctattcctgtcatttt

SEQ ID NO: 395 - protein, 39 aa, Artificial Sequence
  Fc-EMP
MKGGGGGGGTYSCHFGPLTWVCKPQGGGGGGGGTYSCHF

SEQ ID NO: 396 - DNA, 61 bp, Artificial Sequence
  Fc-EMP
gcagaagagcctctccctgtctccgggtaaaggtggaggtggtggtggaggtacttactct

SEQ ID NO: 397 - DNA, 40 bp, Artificial Sequence
  Fc-EMP
ctaattggatccacgagattaaccaccctgcggtttgcaa

SEQ ID NO: 398 - protein, 18 aa, Artificial Sequence
  Fc-EMP
GERWCFDGPLTWVCGEES

SEQ ID NO: 399 - DNA, 61 bp, Artificial Sequence
  Fc-EMP
agagtaagtacctccaccaccacctccacctttacccggagacagggagaggctcttctgc

SEQ ID NO: 400 - DNA, 61 bp, Artificial Sequence
  EMP-Fc
ggcccgctgacctgggtatgtaagccacaagggggtgggggaggcggggggtaatctcgag

SEQ ID NO: 401 - DNA, 50 bp, Artificial Sequence
  EMP-Fc
gatcctcgagattaccccccgcctcccccacccccttgtggcttacatac

SEQ ID NO: 402 - DNA, 118 bp, Artificial Sequence
  EMP-Fc
  CDS (1)..(108)
gtttgcaaaccgcagggtggcggcggcggcggcggtggtacctattcctgtcattttggcccgctgacctgggtatgtaagccacaagggggtgggggaggcggggggtaatctcgag

SEQ ID NO: 403 - protein, 36 aa, Artificial Sequence
  EMP-Fc
VCKPQGGGGGGGGTYSCHFGPLTWVCKPQGGGGGGG

SEQ ID NO: 404 - DNA, 39 bp, Artificial Sequence
  EMP-Fc
ttatttcatatgaaaggtggtaactattcctgtcatttt

SEQ ID NO: 405 - DNA, 43 bp, Artificial Sequence
  EMP-Fc
tggacatgtgtgagttttgtcccccccgcctcccccaccccct

SEQ ID NO: 406 - DNA, 43 bp, Artificial Sequence
  EMP-Fc
agggggtgggggaggcgggggggacaaaactcacacatgtcca

SEQ ID NO: 407 - DNA, 20 bp, Artificial Sequence
  EMP-Fc
gttattgctcagcggtggca

SEQ ID NO: 408 - DNA, 60 bp, Artificial Sequence
  EMP-EMP-Fc
ttttttatcgatttgattctagatttgagttttaacttttagaaggaggaataaaatatg

SEQ ID NO: 409 - DNA, 41 bp, Artificial Sequence
  EMP-EMP-Fc
taaaagttaaaactcaaatctagaatcaaatcgataaaaaa

SEQ ID NO: 410 - DNA, 51 bp, Artificial Sequence
  EMP-EMP-Fc
ggaggtacttactcttgccacttcggcccgctgacttgggtttgcaaaccg

SEQ ID NO: 411 - DNA, 55 bp, Artificial Sequence
  EMP-EMP-Fc
agtcagcgggccgaagtggcaagagtaagtacctcccatattttattcctccttc

SEQ ID NO: 412 - DNA, 60 bp, Artificial Sequence
  EMP-EMP-Fc
cagggtggcggcggcggcggcggtggtacctattcctgtcattttggcccgctgacctgg

SEQ ID NO: 413 - DNA, 60 bp, Artificial Sequence
  EMP-EMP-Fc
aaaatgacaggaataggtaccaccgccgccgccgccgccaccctgcggtttgcaaaccca

SEQ ID NO: 414 - DNA, 57 bp, Artificial Sequence
  EMP-EMP-Fc
gtatgtaagccacaagggggtgggggaggcgggggggacaaaactcacacatgtcca

SEQ ID NO: 415 - DNA, 60 bp, Artificial Sequence
  EMP-EMP-Fc
agttttgtcccccccgcctcccccacccccttgtggcttacatacccaggtcagcgggcc

SEQ ID NO: 416 - DNA, 228 bp, Artificial Sequence
  EMP-EMP-Fc
  CDS (58)..(228)
ttttttatcgatttgattctagatttgagttttaacttttagaaggaggaataaaatatgggaggtacttactcttgccacttcggcccgctgacttgggtttgcaaaccgcagggtggcggcggcggcggcggtggtacctattcctgtcattttggcccgctgacctgggtatgtaagccacaagggggtgggggaggcgggggggacaaaactcacacatgtcca

SEQ ID NO: 417 - protein, 57 aa, Artificial Sequence
  EMP-EMP-Fc
MGGTYSCHFGPLTWVCKPQGGGGGGGGTYSCHFGPLTWVCKPQGGGGGGGDKTHTCP

SEQ ID NO: 418 - DNA, 40 bp, Artificial Sequence
  Fc-EMP-EMP
ctaattggatcctcgagattaacccccttgtggcttacat

SEQ ID NO: 419 - protein, 16 aa, Artificial Sequence
  EPO-MIMETIC PEPTIDE
  misc_feature (1, 3, 9, 14, 15)..(16): Xaa (Positions 1, 3, 9, 14, 15 & 16) can be  any one of the 20 L- amino acids
  misc_feature (5)..(5): Xaa can be R, H, L or W
  misc_feature (6)..(6): Xaa can be M, F or I
  misc_feature (12)..(12): Xaa can be D, E, I, L or V
  misc_feature (13)..(13): Xaa can be C, A, a-amino-y-bromobutyric acid or Hoc
XYXXXXGPXTWXXXXX

SEQ ID NO: 420 - protein, 16 aa, Artificial Sequence
  EPO-MIMETIC PEPTIDE
  misc_feature (1, 3, 5, 6, 9, 12, 14, 15)..(16): Xaa = any amino acid residue
XYXCXXGPXTWXCXXX

SEQ ID NO: 421 - protein, 10 aa, Artificial Sequence
  EPO-MIMETIC PEPTIDE
  misc_feature (2)..(2): Xaa can be R, H, L, or W
  misc_feature (3)..(3): Xaa can be M, F, or I
  misc_feature (6)..(6): Xaa is independently selected from any one of the 20 genetically coded L-amino acids or the steroisomeric D-amino acids
  misc_feature (9)..(9): Xaa can be D, E, I, L, or V.
CXXGPXTWXC

SEQ ID NO: 422 - protein, 19 aa, Artificial Sequence
  EPO-MIMETIC PEPTIDE
GGTYSCHGPLTWVCKPQGG

SEQ ID NO: 423 - protein, 19 aa, Artificial Sequence
  EPO-MIMETIC PEPTIDE
VGNYMAHMGPITWVCRPGG

SEQ ID NO: 424 - protein, 18 aa, Artificial Sequence
  EPO-MIMETIC PEPTIDE
GGPHHVYACRMGPLTWIC

SEQ ID NO: 425 - protein, 18 aa, Artificial Sequence
  EPO-MIMETIC PEPTIDE
GGTYSCHFGPLTWVCKPQ

SEQ ID NO: 426 - protein, 20 aa, Artificial Sequence
  EPO-MIMETIC PEPTIDE
GGLYACHMGPMTWVCQPLRG

SEQ ID NO: 427 - protein, 22 aa, Artificial Sequence
  EPO-MIMETIC PEPTIDE
TIAQYICYMGPETWECRPSPKA

SEQ ID NO: 428 - protein, 13 aa, Artificial Sequence
  EPO-MIMETIC PEPTIDE
YSCHFGPLTWVCK

SEQ ID NO: 429 - protein, 11 aa, Artificial Sequence
  EPO-MIMETIC PEPTIDE
YCHFGPLTWVC

SEQ ID NO: 430 - protein, 17 aa, Artificial Sequence
  UKR ANTAGONIST PEPTIDE
AEPVYQYELDSYLRSYY

SEQ ID NO: 431 - protein, 17 aa, Artificial Sequence
  UKR ANTAGONIST PEPTIDE
AELDLSTFYDIQYLLRT

SEQ ID NO: 432 - protein, 17 aa, Artificial Sequence
  UKR ANTAGONIST PEPTIDE
AEFFKLGPNGYVYLHSA

SEQ ID NO: 433 - protein, 11 aa, Artificial Sequence
  UKR ANTAGONIST PEPTIDE
  misc_feature (4, 5)..(6): Xaa = any amino acid
FKLXXXGYVYL

SEQ ID NO: 434 - protein, 17 aa, Artificial Sequence
  UKR ANTAGONIST PEPTIDE
AESTYHHLSLGYMYTLN

SEQ ID NO: 435 - protein, 11 aa, Artificial Sequence
  UKR ANTAGONIST PEPTIDE
  misc_feature (3, 5)..(6): Xaa = any amino acid
YHXLXXGYMYT

SEQ ID NO: 436 - protein, 6 aa, Artificial Sequence
  MAST CELL ANTAGONISTS/PROTEASE INHIBITOR PEPTIDE
RNRQKT

SEQ ID NO: 437 - protein, 4 aa, Artificial Sequence
  MAST CELL ANTAGONISTS/PROTEASE INHIBITOR PEPTIDE
RNRQ

SEQ ID NO: 438 - protein, 5 aa, Artificial Sequence
  MAST CELL ANTAGONISTS/PROTEASE INHIBITOR PEPTIDE
RNRQK

SEQ ID NO: 439 - protein, 5 aa, Artificial Sequence
  MAST CELL ANTAGONISTS/PROTEASE INHIBITOR PEPTIDE
NRQKT

SEQ ID NO: 440 - protein, 4 aa, Artificial Sequence
  MAST CELL ANTAGONISTS/PROTEASE INHIBITOR PEPTIDE
RQKT

SEQ ID NO: 441 - protein, 7 aa, Artificial Sequence
  INTEGRIN-BINDING PEPTIDE
  misc_feature (2, 5)..(7): Xaa = any amino acid
RXETXWX

SEQ ID NO: 442 - protein, 7 aa, Artificial Sequence
  INTEGRIN-BINDING PEPTIDE
  misc_feature (2, 5)..(7): Xaa = any amino acid
RXETXWX

SEQ ID NO: 443 - protein, 5 aa, Artificial Sequence
  INTEGRIN-BINDING PEPTIDE
  misc_feature (5)..(6): Xaa = any amino acid
RGDGX

SEQ ID NO: 444 - protein, 7 aa, Artificial Sequence
  INTEGRIN-BINDING PEPTIDE
  misc_feature (6)..(6): Xaa = any amino acid
CRGDGXC

SEQ ID NO: 445 - protein, 15 aa, Artificial Sequence
  INTEGRIN-BINDING PEPTIDE
  misc_feature (2, 3, 4, 8, 9, 10, 11, 12, 13)..(14): Xaa = any amino acid
CXXXRLDXXXXXXXC

SEQ ID NO: 446 - protein, 9 aa, Artificial Sequence
  INTEGRIN-BINDING PEPTIDE
CARRLDAPC

SEQ ID NO: 447 - protein, 9 aa, Artificial Sequence
  INTEGRIN-BINDING PEPTIDE
CPSRLDSPC

SEQ ID NO: 448 - protein, 9 aa, Artificial Sequence
  INTEGRIN-BINDING PEPTIDE
  misc_feature (1, 2, 3, 7, 8)..(9): Xaa are capable of forming a cyclizing bond
  misc_feature (2)..(5): Feature at 1, 5 is an amino acid capable of forming a cyclying bo nd and attached to 1-5 amino acid linker
XXXRGDXXX

SEQ ID NO: 449 - protein, 9 aa, Artificial Sequence
  INTEGRIN-BINDING PEPTIDE
  misc_feature (2)..(8): Xaa = any amino acid
CXCRGDCXC

SEQ ID NO: 450 - protein, 9 aa, Artificial Sequence
  INTEGRIN-BINDING PEPTIDE
CDCRGDCFC

SEQ ID NO: 451 - protein, 9 aa, Artificial Sequence
  INTEGRIN-BINDING PEPTIDE
CDCRGDCLC

SEQ ID NO: 452 - protein, 9 aa, Artificial Sequence
  INTEGRIN-BINDING PEPTIDE
CLCRGDCIC

SEQ ID NO: 453 - protein, 8 aa, Artificial Sequence
  INTEGRIN-BINDING PEPTIDE
  misc_feature (1, 2, 5, 6, 7)..(8): Xaa = any amino acid
XXDDXXXX

SEQ ID NO: 454 - protein, 10 aa, Artificial Sequence
  INTEGRIN-BINDING PEPTIDE
  misc_feature (1, 2, 3, 6, 7, 8, 9)..(10): Xaa = any amino acid
XXXDDXXXXX

SEQ ID NO: 455 - protein, 8 aa, Artificial Sequence
  INTEGRIN-BINDING PEPTIDE
CWDDGWLC

SEQ ID NO: 456 - protein, 9 aa, Artificial Sequence
  INTEGRIN-BINDING PEPTIDE
CWDDLWWLC

SEQ ID NO: 457 - protein, 8 aa, Artificial Sequence
  INTEGRIN-BINDING PEPTIDE
CWDDGLMC

SEQ ID NO: 458 - protein, 8 aa, Artificial Sequence
  INTEGRIN-BINDING PEPTIDE
CWDDGWMC

SEQ ID NO: 459 - protein, 9 aa, Artificial Sequence
  INTEGRIN-BINDING PEPTIDE
CSWDDGWLC

SEQ ID NO: 460 - protein, 9 aa, Artificial Sequence
  INTEGRIN-BINDING PEPTIDE
CPDDLWWLC

SEQ ID NO: 461 - protein, 12 aa, Artificial Sequence
  EPO-MIMETIC PEPTIDE
  misc_feature (2)..(8): Xaa can be any of the 20 L-amino acids
  misc_feature (3)..(3): Xaa can be C, A, a-amino-y-bromobutyric acid or Hoc
  misc_feature (4)..(4): Xaa can be R, H, L or W
  misc_feature (5)..(5): Xaa can be M, F or I; Xaa
  misc_feature (11)..(11): Xaa can be D, E, I, L or V
  misc_feature (12)..(12): Xaa can be C, A, a-amino-y-bromobutyric acid or Hoc; provided tha t Xaa (Pos3 or 12) is C or Hoc.
YXXXXGPXTWXX

SEQ ID NO: 462 - protein, 16 aa, Artificial Sequence
  SELECTIN ANTAGONIST PEPTIDE
CQNRYTDLVAIQNKNE

SEQ ID NO: 463 - protein, 17 aa, Artificial Sequence
  SELECTIN ANTAGONIST PEPTIDE
AENWADNEPNNKRNNED

SEQ ID NO: 464 - protein, 19 aa, Artificial Sequence
  SELECTIN ANTAGONIST PEPTIDE
RKNNKTWTWVGTKKALTNE

SEQ ID NO: 465 - protein, 13 aa, Artificial Sequence
  SELECTIN ANTAGONIST PEPTIDE
KKALTNEAENWAD

SEQ ID NO: 466 - protein, 16 aa, Artificial Sequence
  SELECTIN ANTAGONIST PEPTIDE
  misc_feature (3)..(15): Xaa = any amino acid
CQXRYTDLVAIQNKXE

SEQ ID NO: 467 - protein, 19 aa, Artificial Sequence
  SELECTIN ANTAGONIST PEPTIDE
  misc_feature (3, 5, 6, 13)..(15): Xaa = any amino acid
RKXNXXWTWVGTXKXLTEE

SEQ ID NO: 468 - protein, 17 aa, Artificial Sequence
  SELECTIN ANTAGONIST PEPTIDE
  misc_feature (13)..(15): Xaa = any amino acid
AENWADGEPNNKXNXED

SEQ ID NO: 469 - protein, 16 aa, Artificial Sequence
  SELECTIN ANTAGONIST PEPTIDE
  misc_feature (2, 3, 4, 7)..(15): Xaa = any amino acid
CXXXYTXLVAIQNKXE

SEQ ID NO: 470 - protein, 19 aa, Artificial Sequence
  SELECTIN ANTAGONIST PEPTIDE
  misc_feature (3, 4, 5, 6, 8, 13, 15)..(18): Xaa = any amino acid
RKXXXXWXWVGTXKXLTXE

SEQ ID NO: 471 - protein, 16 aa, Artificial Sequence
  SELECTIN ANTAGONIST PEPTIDE
  misc_feature (2, 5, 6, 7, 12, 13)..(14): Xaa = any amino acid
AXNWXXXEPNNXXXED

SEQ ID NO: 472 - protein, 13 aa, Artificial Sequence
  SELECTIN ANTAGONIST PEPTIDE
  misc_feature (1, 3, 6, 9, 12)..(13): Xaa = any amino acid
XKXKTXEAXNWXX

SEQ ID NO: 473 - protein, 12 aa, Artificial Sequence
  SOMATOSTATIN OR CORTISTATIN MIMETIC PEPTIDE
  misc_feature (1)..(1): Xaa is Asp-Arg-Met-Pro-Cys, Arg-Met-Pro-Cys, Met-Pro-Cys, Pro-Cys or Cys
  misc_feature (2)..(2): Xaa is Arg or Lys
  misc_feature (10)..(10): Xaa is Ser or Thr
  misc_feature (12)..(12): Xaa is Cys-Lys or Cys
XXNFFWKTFXSX

SEQ ID NO: 474 - protein, 17 aa, Artificial Sequence
  SOMATOSTATIN OR CORTISTATIN MIMETIC PEPTIDE
DRMPCRNFFWKTFSSCK

SEQ ID NO: 475 - protein, 15 aa, Artificial Sequence
  SOMATOSTATIN OR CORTISTATIN MIMETIC PEPTIDE
MPCRNFFWKTFSSCK

SEQ ID NO: 476 - protein, 13 aa, Artificial Sequence
  SOMATOSTATIN OR CORTISTATIN MIMETIC PEPTIDE
CRNFFWKTFSSCK

SEQ ID NO: 477 - protein, 16 aa, Artificial Sequence
  SOMATOSTATIN OR CORTISTATIN MIMETIC PEPTIDE
DRMPCRNFFWKTFSSC

SEQ ID NO: 478 - protein, 14 aa, Artificial Sequence
  SOMATOSTATIN OR CORTISTATIN MIMETIC PEPTIDE
MPCRNFFWKTFSSC

SEQ ID NO: 479 - protein, 12 aa, Artificial Sequence
  SOMATOSTATIN OR CORTISTATIN MIMETIC PEPTIDE
CRNFFWKTFSSC

SEQ ID NO: 480 - protein, 16 aa, Artificial Sequence
  SOMATOSTATIN OR CORTISTATIN MIMETIC PEPTIDE
DRMPCKNFFWKTFSSC

SEQ ID NO: 481 - protein, 15 aa, Artificial Sequence
  SOMATOSTATIN OR CORTISTATIN MIMETIC PEPTIDE
MPCKNFFWKTFSSCK

SEQ ID NO: 482 - protein, 13 aa, Artificial Sequence
  SOMATOSTATIN OR CORTISTATIN MIMETIC PEPTIDE
CKNFFWKTFSSCK

SEQ ID NO: 483 - protein, 16 aa, Artificial Sequence
  SOMATOSTATIN OR CORTISTATIN MIMETIC PEPTIDE
DRMPCKNFFWKTFSSC

SEQ ID NO: 484 - protein, 14 aa, Artificial Sequence
  SOMATOSTATIN OR CORTISTATIN MIMETIC PEPTIDE
MPCKNFFWKTFSSC

SEQ ID NO: 485 - protein, 12 aa, Artificial Sequence
  SOMATOSTATIN OR CORTISTATIN MIMETIC PEPTIDE
CKNFFWKTFSSC

SEQ ID NO: 486 - protein, 17 aa, Artificial Sequence
  SOMATOSTATIN OR CORTISTATIN MIMETIC PEPTIDE
DRMPCRNFFWKTFTSCK

SEQ ID NO: 487 - protein, 15 aa, Artificial Sequence
  SOMATOSTATIN OR CORTISTATIN MIMETIC PEPTIDE
MPCRNFFWKTFTSCK

SEQ ID NO: 488 - protein, 13 aa, Artificial Sequence
  SOMATOSTATIN OR CORTISTATIN MIMETIC PEPTIDE
CRNFFWKTFTSCK

SEQ ID NO: 489 - protein, 16 aa, Artificial Sequence
  SOMATOSTATIN OR CORTISTATIN MIMETIC PEPTIDE
DRMPCRNFFWKTFTSC

SEQ ID NO: 490 - protein, 14 aa, Artificial Sequence
  SOMATOSTATIN OR CORTISTATIN MIMETIC PEPTIDE
MPCRNFFWKTFTSC

SEQ ID NO: 491 - protein, 12 aa, Artificial Sequence
  SOMATOSTATIN OR CORTISTATIN MIMETIC PEPTIDE
CRNFFWKTFTSC

SEQ ID NO: 492 - protein, 17 aa, Artificial Sequence
  SOMATOSTATIN OR CORTISTATIN MIMETIC PEPTIDE
DRMPCKNFFWKTFTSCK

SEQ ID NO: 493 - protein, 15 aa, Artificial Sequence
  SOMATOSTATIN OR CORTISTATIN MIMETIC PEPTIDE
MPCKNFFWKTFTSCK

SEQ ID NO: 494 - protein, 13 aa, Artificial Sequence
  SOMATOSTATIN OR CORTISTATIN MIMETIC PEPTIDE
CKNFFWKTFTSCK

SEQ ID NO: 495 - protein, 16 aa, Artificial Sequence
  SOMATOSTATIN OR CORTISTATIN MIMETIC PEPTIDE
DRMPCKNFFWKTFTSC

SEQ ID NO: 496 - protein, 14 aa, Artificial Sequence
  SOMATOSTATIN OR CORTISTATIN MIMETIC PEPTIDE
MPCKNFFWKTFTSC

SEQ ID NO: 497 - protein, 12 aa, Artificial Sequence
  SOMATOSTATIN OR CORTISTATIN MIMETIC PEPTIDE
CKNFFWKTFTSC

SEQ ID NO: 498 - protein, 25 aa, Artificial Sequence
  CAP37 MIMETIC/LPS BINDING
NQGRHFCGGALIHARFVMTAASCFQ

SEQ ID NO: 499 - protein, 20 aa, Artificial Sequence
  CAP37 MIMETIC/LPS BINDING
RHFCGGALIHARFVMTAASC

SEQ ID NO: 500 - protein, 27 aa, Artificial Sequence
  CAP37 MIMETIC/LPS BINDING
GTRCQVAGWGSQRSGGRLSRFPRFVNV

SEQ ID NO: 501 - protein, 18 aa, Artificial Sequence
  VEGF- ANTAGONIST
GERWCFDGPRAWVCGWEI

SEQ ID NO: 502 - protein, 18 aa, Artificial Sequence
  VEGF- ANTAGONIST
EELWCFDGPRAWVCGYVK

SEQ ID NO: 503 - protein, 33 aa, Artificial Sequence
  ANTIPATHOGENIC PEPTIDE
GFFALIPKIISSPLFKTLLSAVGSALSSSGGQQ

SEQ ID NO: 504 - protein, 33 aa, Artificial Sequence
  ANTIPATHOGENIC PEPTIDE
  misc_feature (7, 18,)..(19): Positions 7, 18, and 19, D amino acid residue
GFFALIPKIISSPLFKTLLSAVGSALSSSGGQE

SEQ ID NO: 505 - protein, 22 aa, Artificial Sequence
  ANTIPATHOGENIC PEPTIDE
  misc_feature (18)..(19): Positions 18 and 19, D amino acid residues
GFFALIPKIISSPLFKTLLSAV

SEQ ID NO: 506 - protein, 22 aa, Artificial Sequence
  ANTIPATHOGENIC PEPTIDE
  misc_feature (7, 18)..(19): Positions 7, 18 and 19, D amino acid residues
GFFALIPKIISSPLFKTLLSAV

SEQ ID NO: 507 - protein, 23 aa, Artificial Sequence
  ANTIPATHOGENIC PEPTIDE
  misc_feature (8, 19)..(20): Positions 8, 19 and 20, D amino acid residues
KGFFALIPKIISSPLFKTLLSAV

SEQ ID NO: 508 - protein, 24 aa, Artificial Sequence
  ANTIPATHOGENIC PEPTIDE
  misc_feature (9, 20)..(21): Positions 9, 20 and 21, D amino acid residues
KKGFFALIPKIISSPLFKTLLSAV

SEQ ID NO: 509 - protein, 24 aa, Artificial Sequence
  ANTIPATHOGENIC PEPTIDE
  misc_feature (9, 20)..(21): Positions 9, 20 and 21, D amino acid residues
KKGFFALIPKIISSPLFKTLLSAV

SEQ ID NO: 510 - protein, 11 aa, Artificial Sequence
  ANTIPATHOGENIC PEPTIDE
  misc_feature (7)..(7): Position 7, D amino acid residue
GFFALIPKIIS

SEQ ID NO: 511 - protein, 26 aa, Artificial Sequence
  ANTIPATHOGENIC PEPTIDE
GIGAVLKVLTTGLPALISWIKRKRQQ

SEQ ID NO: 512 - protein, 26 aa, Artificial Sequence
  ANTIPATHOGENIC PEPTIDE
  misc_feature (5, 8, 17)..(23): Positions 5, 8, 17 and 23, D amino acid residues
GIGAVLKVLTTGLPALISWIKRKRQQ

SEQ ID NO: 513 - protein, 26 aa, Artificial Sequence
  ANTIPATHOGENIC PEPTIDE
  misc_feature (5, 18, 17)..(23): Positions 5, 18, 17 and 23, D amino acid residues
GIGAVLKVLTTGLPALISWIKRKRQQ

SEQ ID NO: 514 - protein, 22 aa, Artificial Sequence
  ANTIPATHOGENIC PEPTIDE
  misc_feature (5, 8, 17)..(21): Positions 5, 8, 17 and 21, D amino acid residues
GIGAVLKVLTTGLPALISWIKR

SEQ ID NO: 515 - protein, 19 aa, Artificial Sequence
  ANTIPATHOGENIC PEPTIDE
  misc_feature (2, 5, 14)..(18): Positions 2, 5, 14 and 18, D amino acid residues
AVLKVLTTGLPALISWIKR

SEQ ID NO: 516 - protein, 12 aa, Artificial Sequence
  ANTIPATHOGENIC PEPTIDE
  misc_feature (3, 4, 8)..(10): Positions 3, 4, 8 and 10, D amino acid residues
KLLLLLKLLLLK

SEQ ID NO: 517 - protein, 12 aa, Artificial Sequence
  ANTIPATHOGENIC PEPTIDE
  misc_feature (3, 4, 8)..(10): Positions 3, 4, 8 and 10, D amino acid residues
KLLLKLLLKLLK

SEQ ID NO: 518 - protein, 12 aa, Artificial Sequence
  ANTIPATHOGENIC PEPTIDE
  misc_feature (3, 4, 8)..(10): Positions 3, 4, 8 and 10, D amino acid residues
KLLLKLKLKLLK

SEQ ID NO: 519 - protein, 12 aa, Artificial Sequence
  ANTIPATHOGENIC PEPTIDE
KKLLKLKLKLKK

SEQ ID NO: 520 - protein, 12 aa, Artificial Sequence
  ANTIPATHOGENIC PEPTIDE
KLLLKLLLKLLK

SEQ ID NO: 521 - protein, 12 aa, Artificial Sequence
  ANTIPATHOGENIC PEPTIDE
KLLLKLKLKLLK

SEQ ID NO: 522 - protein, 6 aa, Artificial Sequence
  ANTIPATHOGENIC PEPTIDE
KLLLLK

SEQ ID NO: 523 - protein, 8 aa, Artificial Sequence
  ANTIPATHOGENIC PEPTIDE
KLLLKLLK

SEQ ID NO: 524 - protein, 12 aa, Artificial Sequence
  ANTIPATHOGENIC PEPTIDE
KLLLKLKLKLLK

SEQ ID NO: 525 - protein, 12 aa, Artificial Sequence
  ANTIPATHOGENIC PEPTIDE
KLLLKLKLKLLK

SEQ ID NO: 526 - protein, 12 aa, Artificial Sequence
  ANTIPATHOGENIC PEPTIDE
KLLLKLKLKLLK

SEQ ID NO: 527 - protein, 12 aa, Artificial Sequence
  ANTIPATHOGENIC PEPTIDE
KAAAKAAAKAAK

SEQ ID NO: 528 - protein, 12 aa, Artificial Sequence
  ANTIPATHOGENIC PEPTIDE
KVVVKVVVKVVK

SEQ ID NO: 529 - protein, 12 aa, Artificial Sequence
  ANTIPATHOGENIC PEPTIDE
KVVVKVKVKVVK

SEQ ID NO: 530 - protein, 11 aa, Artificial Sequence
  ANTIPATHOGENIC PEPTIDE
KVVVKVKVKVK

SEQ ID NO: 531 - protein, 12 aa, Artificial Sequence
  ANTIPATHOGENIC PEPTIDE
KVVVKVKVKVVK

SEQ ID NO: 532 - protein, 6 aa, Artificial Sequence
  ANTIPATHOGENIC PEPTIDE
KLILKL

SEQ ID NO: 533 - protein, 6 aa, Artificial Sequence
  ANTIPATHOGENIC PEPTIDE
KVLHLL

SEQ ID NO: 534 - protein, 6 aa, Artificial Sequence
  ANTIPATHOGENIC PEPTIDE
LKLRLL

SEQ ID NO: 535 - protein, 6 aa, Artificial Sequence
  ANTIPATHOGENIC PEPTIDE
KPLHLL

SEQ ID NO: 536 - protein, 8 aa, Artificial Sequence
  ANTIPATHOGENIC PEPTIDE
KLILKLVR

SEQ ID NO: 537 - protein, 8 aa, Artificial Sequence
  ANTIPATHOGENIC PEPTIDE
KVFHLLHL

SEQ ID NO: 538 - protein, 8 aa, Artificial Sequence
  ANTIPATHOGENIC PEPTIDE
HKFRILKL

SEQ ID NO: 539 - protein, 8 aa, Artificial Sequence
  ANTIPATHOGENIC PEPTIDE
KPFHILHL

SEQ ID NO: 540 - protein, 12 aa, Artificial Sequence
  ANTIPATHOGENIC PEPTIDE
KIIIKIKIKIIK

SEQ ID NO: 541 - protein, 12 aa, Artificial Sequence
  ANTIPATHOGENIC PEPTIDE
KIIIKIKIKIIK

SEQ ID NO: 542 - protein, 12 aa, Artificial Sequence
  ANTIPATHOGENIC PEPTIDE
KIIIKIKIKIIK

SEQ ID NO: 543 - protein, 12 aa, Artificial Sequence
  ANTIPATHOGENIC PEPTIDE
KIPIKIKIKIPK

SEQ ID NO: 544 - protein, 12 aa, Artificial Sequence
  ANTIPATHOGENIC PEPTIDE
KIPIKIKIKIVK

SEQ ID NO: 545 - protein, 12 aa, Artificial Sequence
  ANTIPATHOGENIC PEPTIDE
RIIIRIRIRIIR

SEQ ID NO: 546 - protein, 12 aa, Artificial Sequence
  ANTIPATHOGENIC PEPTIDE
RIIIRIRIRIIR

SEQ ID NO: 547 - protein, 12 aa, Artificial Sequence
  ANTIPATHOGENIC PEPTIDE
RIIIRIRIRIIR

SEQ ID NO: 548 - protein, 12 aa, Artificial Sequence
  ANTIPATHOGENIC PEPTIDE
RIVIRIRIRLIR

SEQ ID NO: 549 - protein, 12 aa, Artificial Sequence
  ANTIPATHOGENIC PEPTIDE
RIIVRIRLRIIR

SEQ ID NO: 550 - protein, 12 aa, Artificial Sequence
  ANTIPATHOGENIC PEPTIDE
RIGIRLRVRIIR

SEQ ID NO: 551 - protein, 12 aa, Artificial Sequence
  ANTIPATHOGENIC PEPTIDE
KIVIRIRIRLIR

SEQ ID NO: 552 - protein, 12 aa, Artificial Sequence
  ANTIPATHOGENIC PEPTIDE
RIAVKWRLRFIK

SEQ ID NO: 553 - protein, 12 aa, Artificial Sequence
  ANTIPATHOGENIC PEPTIDE
KIGWKLRVRIIR

SEQ ID NO: 554 - protein, 12 aa, Artificial Sequence
  ANTIPATHOGENIC PEPTIDE
KKIGWLIIRVRR

SEQ ID NO: 555 - protein, 14 aa, Artificial Sequence
  ANTIPATHOGENIC PEPTIDE
RIVIRIRIRLIRIR

SEQ ID NO: 556 - protein, 14 aa, Artificial Sequence
  ANTIPATHOGENIC PEPTIDE
RIIVRIRLRIIRVR

SEQ ID NO: 557 - protein, 14 aa, Artificial Sequence
  ANTIPATHOGENIC PEPTIDE
RIGIRLRVRIIRRV

SEQ ID NO: 558 - protein, 16 aa, Artificial Sequence
  ANTIPATHOGENIC PEPTIDE
KIVIRIRARLIRIRIR

SEQ ID NO: 559 - protein, 16 aa, Artificial Sequence
  ANTIPATHOGENIC PEPTIDE
RIIVKIRLRIIKKIRL

SEQ ID NO: 560 - protein, 16 aa, Artificial Sequence
  ANTIPATHOGENIC PEPTIDE
KIGIKARVRIIRVKII

SEQ ID NO: 561 - protein, 16 aa, Artificial Sequence
  ANTIPATHOGENIC PEPTIDE
RIIVHIRLRIIHHIRL

SEQ ID NO: 562 - protein, 16 aa, Artificial Sequence
  ANTIPATHOGENIC PEPTIDE
HIGIKAHVRIIRVHII

SEQ ID NO: 563 - protein, 16 aa, Artificial Sequence
  ANTIPATHOGENIC PEPTIDE
RIYVKIHLRYIKKIRL

SEQ ID NO: 564 - protein, 16 aa, Artificial Sequence
  ANTIPATHOGENIC PEPTIDE
KIGHKARVHIIRYKII

SEQ ID NO: 565 - protein, 16 aa, Artificial Sequence
  ANTIPATHOGENIC PEPTIDE
RIYVKPHPRYIKKIRL

SEQ ID NO: 566 - protein, 16 aa, Artificial Sequence
  ANTIPATHOGENIC PEPTIDE
KPGHKARPHIIRYKII

SEQ ID NO: 567 - protein, 19 aa, Artificial Sequence
  ANTIPATHOGENIC PEPTIDE
KIVIRIRIRLIRIRIRKIV

SEQ ID NO: 568 - protein, 19 aa, Artificial Sequence
  ANTIPATHOGENIC PEPTIDE
RIIVKIRLRIIKKIRLIKK

SEQ ID NO: 569 - protein, 19 aa, Artificial Sequence
  ANTIPATHOGENIC PEPTIDE
KIGWKLRVRIIRVKIGRLR

SEQ ID NO: 570 - protein, 25 aa, Artificial Sequence
  ANTIPATHOGENIC PEPTIDE
KIVIRIRIRLIRIRIRKIVKVKRIR

SEQ ID NO: 571 - protein, 26 aa, Artificial Sequence
  ANTIPATHOGENIC PEPTIDE
RFAVKIRLRIIKKIRLIKKIRKRVIK

SEQ ID NO: 572 - protein, 30 aa, Artificial Sequence
  ANTIPATHOGENIC PEPTIDE
KAGWKLRVRIIRVKIGRLRKIGWKKRVRIK

SEQ ID NO: 573 - protein, 16 aa, Artificial Sequence
  ANTIPATHOGENIC PEPTIDE
RIYVKPHPRYIKKIRL

SEQ ID NO: 574 - protein, 16 aa, Artificial Sequence
  ANTIPATHOGENIC PEPTIDE
KPGHKARPHIIRYKII

SEQ ID NO: 575 - protein, 19 aa, Artificial Sequence
  ANTIPATHOGENIC PEPTIDE
KIVIRIRIRLIRIRIRKIV

SEQ ID NO: 576 - protein, 19 aa, Artificial Sequence
  ANTIPATHOGENIC PEPTIDE
RIIVKIRLRIIKKIRLIKK

SEQ ID NO: 577 - protein, 16 aa, Artificial Sequence
  ANTIPATHOGENIC PEPTIDE
RIYVSKISIYIKKIRL

SEQ ID NO: 578 - protein, 19 aa, Artificial Sequence
  ANTIPATHOGENIC PEPTIDE
KIVIFTRIRLTSIRIRSIV

SEQ ID NO: 579 - protein, 16 aa, Artificial Sequence
  ANTIPATHOGENIC PEPTIDE
KPIHKARPTIIRYKMI

SEQ ID NO: 580 - protein, 26 aa, Artificial Sequence
  ANTIPATHOGENIC PEPTIDE
  misc_feature (1)..(1): Position 1, disulfide bond to position 26
  misc_feature (26)..(26): Position 26, disulfide bond to position 1
XCKGFFALIPKIISSPLFKTLLSAVC

SEQ ID NO: 581 - protein, 26 aa, Artificial Sequence
  ANTIPATHOGENIC PEPTIDE
CKKGFFALIPKIISSPLFKTLLSAVC

SEQ ID NO: 582 - protein, 27 aa, Artificial Sequence
  ANTIPATHOGENIC PEPTIDE
CKKKGFFALIPKIISSPLFKTLLSAVC

SEQ ID NO: 583 - protein, 17 aa, Artificial Sequence
  ANTIPATHOGENIC PEPTIDE
  misc_feature (1)..(1): Position 1, disulfide bond to position 17
  misc_feature (17)..(17): Position 17, disulfide bond to position 1
XCRIVIRIRIRLIRIRC

SEQ ID NO: 584 - protein, 19 aa, Artificial Sequence
  ANTIPATHOGENIC PEPTIDE
  misc_feature (1)..(1): Position 1, disulfide bond to position 19
  misc_feature (19)..(19): Position 19, disulfide bond to position 1
XCKPGHKARPHIIRYKIIC

SEQ ID NO: 585 - protein, 29 aa, Artificial Sequence
  ANTIPATHOGENIC PEPTIDE
  misc_feature (1)..(1): Position 1, disulfide bond to position 29
  misc_feature (29)..(29): Position 29, disulfide bond to position 1
XCRFAVKIRLRIIKKIRLIKKIRKRVIKC

SEQ ID NO: 586 - protein, 13 aa, Artificial Sequence
  ANTIPATHOGENIC PEPTIDE
KLLLKLLLKLLKC

SEQ ID NO: 587 - protein, 12 aa, Artificial Sequence
  ANTIPATHOGENIC PEPTIDE
KLLLKLLLKLLK

SEQ ID NO: 588 - protein, 13 aa, Artificial Sequence
  ANTIPATHOGENIC PEPTIDE
KLLLKLKLKLLKC

SEQ ID NO: 589 - protein, 12 aa, Artificial Sequence
  ANTIPATHOGENIC PEPTIDE
KLLLKLLLKLLK

SEQ ID NO: 590 - protein, 28 aa, Artificial Sequence
  VIP-MIMETIC PEPTIDE
HSDAVFYDNYTRLRKQMAVKKYLNSILN

SEQ ID NO: 591 - protein, 28 aa, Artificial Sequence
  VIP-MIMETIC PEPTIDE
HSDAVFYDNYTRLRKQMAVKKYLNSILN

SEQ ID NO: 592 - protein, 3 aa, Artificial Sequence
  VIP-MIMETIC PEPTIDE
  misc_feature (1)..(1): Position 1, Xaa is L-Lys, D-Lys or an ornithinyl residue
  misc_feature (2)..(2): Position 2, Xaa is L-Tyr, D-Tyr, Phe, Trp or a p-aminophenylalany l residue
  misc_feature (3)..(3): Position 3 is a hydrophobic aliphatic amino acid residue, Positio n 3, optional attachment to Leu, norleucyl, D-Ala, Asn-Ser, Asn-S er-Ile-, Asn-Ser-Tyr, Ser-Ile-Leu, Asn-Ser-Tyr-Leu or Asn-Ser-Tyr -Leu-Asn
XXX

SEQ ID NO: 593 - protein, 5 aa, Artificial Sequence
  VIP-MIMETIC PEPTIDE
  misc_feature (1)..(3): Position 1, Xaa is either absent, a hydrophobic aliphatic residue (X5), X5-Asn, Tyr-X5, Lys-X5, Lys-X5-Asn, Lys-Tyr-X5, Lys-Tyr-X5 -Asn, Lys-Lys-Tyr-X5, Lys-Lys-Tyr-X5-Asn, Val-Lys-Lys-Tyr-X5, Val -Ala-Lys-Lys-Tyr-X5-Asn, or Ala-Val-Lys-Lys-Tyr-X5-Asn
XSXLN

SEQ ID NO: 594 - protein, 7 aa, Artificial Sequence
  VIP-MIMETIC PEPTIDE
  misc_feature (1, 5, 6)..(7): Positions 1 and 6, Xaa are cross-linked amino acid residues as de fined in WO97/40070
  misc_feature (5)..(5): Position 5, Xaa is a hydrophobic aliphatic aminod acid residue
  misc_feature (7)..(7): Position 7, is a covalent bond or Asn, Ser, Ile, Tyr, Leu, Asn-Se r, Asn-Ser-Ile, Asn-Ser-Tyr, Asn-Ser-Ile-Leu, Asn-Ser-Tyr-Leu, As n-Ser-Ile-Leu-Asn or Asn-Ser-Tyr-Leu-Asn.
XKKYXXX

SEQ ID NO: 595 - protein, 4 aa, Artificial Sequence
  VIP-MIMETIC PEPTIDE
KKYL

SEQ ID NO: 596 - protein, 5 aa, Artificial Sequence
  VIP-MIMETIC PEPTIDE
NSILN

SEQ ID NO: 597 - protein, 4 aa, Artificial Sequence
  VIP-MIMETIC PEPTIDE
KKYL

SEQ ID NO: 598 - protein, 4 aa, Artificial Sequence
  VIP-MIMETIC PEPTIDE
KKYA

SEQ ID NO: 599 - protein, 6 aa, Artificial Sequence
  VIP-MIMETIC PEPTIDE
AVKKYL

SEQ ID NO: 600 - protein, 4 aa, Artificial Sequence
  VIP-MIMETIC PEPTIDE
SILN

SEQ ID NO: 601 - protein, 4 aa, Artificial Sequence
  VIP-MIMETIC PEPTIDE
KKYV

SEQ ID NO: 602 - protein, 4 aa, Artificial Sequence
  VIP-MIMETIC PEPTIDE
  misc_feature (3)..(3): Position 3, Xaa is a lauric acid residue
SIXN

SEQ ID NO: 603 - protein, 5 aa, Artificial Sequence
  VIP-MIMETIC PEPTIDE
  misc_feature (5)..(5): Position 5, Xaa is a norleucyl residue
KKYLX

SEQ ID NO: 604 - protein, 5 aa, Artificial Sequence
  VIP-MIMETIC PEPTIDE
NSYLN

SEQ ID NO: 605 - protein, 5 aa, Artificial Sequence
  VIP-MIMETIC PEPTIDE
NSIYN

SEQ ID NO: 606 - protein, 11 aa, Artificial Sequence
  VIP-MIMETIC PEPTIDE
KKYLPPNSILN

SEQ ID NO: 607 - protein, 5 aa, Artificial Sequence
  VIP-MIMETIC PEPTIDE
  misc_feature (1)..(1): Position 1, Xaa is a lauric acid residue
XKKYL

SEQ ID NO: 608 - protein, 5 aa, Artificial Sequence
  VIP-MIMETIC PEPTIDE
  misc_feature (1)..(1): Position 1, Xaa is a caproic acid residue
XKKYL

SEQ ID NO: 609 - protein, 4 aa, Artificial Sequence
  VIP-MIMETIC PEPTIDE
  misc_feature (4)..(4): Position 4, Xaa is a norleucyl residue
KKYX

SEQ ID NO: 610 - protein, 5 aa, Artificial Sequence
  VIP-MIMETIC PEPTIDE
VKKYL

SEQ ID NO: 611 - protein, 6 aa, Artificial Sequence
  VIP-MIMETIC PEPTIDE
LNSILN

SEQ ID NO: 612 - protein, 7 aa, Artificial Sequence
  VIP-MIMETIC PEPTIDE
YLNSILN

SEQ ID NO: 613 - protein, 5 aa, Artificial Sequence
  VIP-MIMETIC PEPTIDE
KKYLN

SEQ ID NO: 614 - protein, 6 aa, Artificial Sequence
  VIP-MIMETIC PEPTIDE
KKYLNS

SEQ ID NO: 615 - protein, 7 aa, Artificial Sequence
  VIP-MIMETIC PEPTIDE
KKYLNSI

SEQ ID NO: 616 - protein, 8 aa, Artificial Sequence
  VIP-MIMETIC PEPTIDE
KKYLNSIL

SEQ ID NO: 617 - protein, 4 aa, Artificial Sequence
  VIP-MIMETIC PEPTIDE
KKYL

SEQ ID NO: 618 - protein, 5 aa, Artificial Sequence
  VIP-MIMETIC PEPTIDE
KKYDA

SEQ ID NO: 619 - protein, 6 aa, Artificial Sequence
  VIP-MIMETIC PEPTIDE
AVKKYL

SEQ ID NO: 620 - protein, 5 aa, Artificial Sequence
  VIP-MIMETIC PEPTIDE
NSILN

SEQ ID NO: 621 - protein, 4 aa, Artificial Sequence
  VIP-MIMETIC PEPTIDE
KKYV

SEQ ID NO: 622 - protein, 4 aa, Artificial Sequence
  VIP-MIMETIC PEPTIDE
  misc_feature (1)..(3): Position 3, Xaa is a lauric acid residue
XIXN

SEQ ID NO: 623 - protein, 5 aa, Artificial Sequence
  VIP-MIMETIC PEPTIDE
NSYLN

SEQ ID NO: 624 - protein, 5 aa, Artificial Sequence
  VIP-MIMETIC PEPTIDE
NSIYN

SEQ ID NO: 625 - protein, 5 aa, Artificial Sequence
  VIP-MIMETIC PEPTIDE
  misc_feature (5)..(5): Position 5, Xaa is a norleucyl residue
KKYLX

SEQ ID NO: 626 - protein, 11 aa, Artificial Sequence
  VIP-MIMETIC PEPTIDE
KKYLPPNSILN

SEQ ID NO: 627 - protein, 4 aa, Artificial Sequence
  VIP-MIMETIC PEPTIDE
KKYL

SEQ ID NO: 628 - protein, 5 aa, Artificial Sequence
  VIP-MIMETIC PEPTIDE
KKYDA

SEQ ID NO: 629 - protein, 6 aa, Artificial Sequence
  VIP-MIMETIC PEPTIDE
AVKKYL

SEQ ID NO: 630 - protein, 5 aa, Artificial Sequence
  VIP-MIMETIC PEPTIDE
NSILN

SEQ ID NO: 631 - protein, 4 aa, Artificial Sequence
  VIP-MIMETIC PEPTIDE
KKYV

SEQ ID NO: 632 - protein, 4 aa, Artificial Sequence
  VIP-MIMETIC PEPTIDE
  misc_feature (1)..(3): Position 3, Xaa is a lauric acid residue
XIXN

SEQ ID NO: 633 - protein, 5 aa, Artificial Sequence
  VIP-MIMETIC PEPTIDE
  misc_feature (1)..(1): Position 1, Xaa is a lauric acid residue
XKKYL

SEQ ID NO: 634 - protein, 5 aa, Artificial Sequence
  VIP-MIMETIC PEPTIDE
  misc_feature (1)..(1): Position 1, Xaa is a caproic acid residue
XKKYL

SEQ ID NO: 635 - protein, 4 aa, Artificial Sequence
  VIP-MIMETIC PEPTIDE
  misc_feature (4)..(4): Position 4, Xaa is a norleucyl residue
KKYX

SEQ ID NO: 636 - protein, 5 aa, Artificial Sequence
  VIP-MIMETIC PEPTIDE
VKKYL

SEQ ID NO: 637 - protein, 6 aa, Artificial Sequence
  VIP-MIMETIC PEPTIDE
LNSILN

SEQ ID NO: 638 - protein, 7 aa, Artificial Sequence
  VIP-MIMETIC PEPTIDE
YLNSILN

SEQ ID NO: 639 - protein, 5 aa, Artificial Sequence
  VIP-MIMETIC PEPTIDE
  misc_feature (5)..(5): Position 5, Xaa is a norleucyl residue
KKYLX

SEQ ID NO: 640 - protein, 5 aa, Artificial Sequence
  VIP-MIMETIC PEPTIDE
KKYLN

SEQ ID NO: 641 - protein, 6 aa, Artificial Sequence
  VIP-MIMETIC PEPTIDE
KKYLNS

SEQ ID NO: 642 - protein, 7 aa, Artificial Sequence
  VIP-MIMETIC PEPTIDE
KKYLNSI

SEQ ID NO: 643 - protein, 8 aa, Artificial Sequence
  VIP-MIMETIC PEPTIDE
KKYLNSIL

SEQ ID NO: 644 - protein, 6 aa, Artificial Sequence
  VIP-MIMETIC PEPTIDE
KKKYLD

SEQ ID NO: 645 - protein, 7 aa, Artificial Sequence
  VIP-MIMETIC PEPTIDE
  misc_feature (1)..(1): Positions 1 and 6 disulfide cross-linked
XCKKYLC

SEQ ID NO: 646 - protein, 6 aa, Artificial Sequence
  VIP-MIMETIC PEPTIDE
  misc_feature: Positions 1 and 6 cross-linked by S-CH2-CO
CKKYLK

SEQ ID NO: 647 - protein, 4 aa, Artificial Sequence
  VIP-MIMETIC PEPTIDE
  misc_feature: Position 4, D amino acid residue
KKYA

SEQ ID NO: 648 - protein, 8 aa, Artificial Sequence
  VIP-MIMETIC PEPTIDE
WWTDTGLW

SEQ ID NO: 649 - protein, 8 aa, Artificial Sequence
  VIP-MIMETIC PEPTIDE
WWTDDGLW

SEQ ID NO: 650 - protein, 12 aa, Artificial Sequence
  VIP-MIMETIC PEPTIDE
WWDTRGLWVWTI

SEQ ID NO: 651 - protein, 12 aa, Artificial Sequence
  VIP-MIMETIC PEPTIDE
FWGNDGIWLESG

SEQ ID NO: 652 - protein, 12 aa, Artificial Sequence
  VIP-MIMETIC PEPTIDE
DWDQFGLWRGAA

SEQ ID NO: 653 - protein, 12 aa, Artificial Sequence
  VIP-MIMETIC PEPTIDE
RWDDNGLWVVVL

SEQ ID NO: 654 - protein, 12 aa, Artificial Sequence
  VIP-MIMETIC PEPTIDE
SGMWSHYGIWMG

SEQ ID NO: 655 - protein, 12 aa, Artificial Sequence
  VIP-MIMETIC PEPTIDE
GGRWDQAGLWVA

SEQ ID NO: 656 - protein, 12 aa, Artificial Sequence
  VIP-MIMETIC PEPTIDE
KLWSEQGIWMGE

SEQ ID NO: 657 - protein, 10 aa, Artificial Sequence
  VIP-MIMETIC PEPTIDE
CWSMHGLWLC

SEQ ID NO: 658 - protein, 12 aa, Artificial Sequence
  VIP-MIMETIC PEPTIDE
GCWDNTGIWVPC

SEQ ID NO: 659 - protein, 10 aa, Artificial Sequence
  VIP-MIMETIC PEPTIDE
DWDTRGLWVY

SEQ ID NO: 660 - protein, 10 aa, Artificial Sequence
  VIP-MIMETIC PEPTIDE
SLWDENGAWI

SEQ ID NO: 661 - protein, 10 aa, Artificial Sequence
  VIP-MIMETIC PEPTIDE
KWDDRGLWMH

SEQ ID NO: 662 - protein, 10 aa, Artificial Sequence
  VIP-MIMETIC PEPTIDE
QAWNERGLWT

SEQ ID NO: 663 - protein, 10 aa, Artificial Sequence
  VIP-MIMETIC PEPTIDE
QWDTRGLWVA

SEQ ID NO: 664 - protein, 9 aa, Artificial Sequence
  VIP-MIMETIC PEPTIDE
WNVHGIWQE

SEQ ID NO: 665 - protein, 10 aa, Artificial Sequence
  VIP-MIMETIC PEPTIDE
SWDTRGLWVE

SEQ ID NO: 666 - protein, 10 aa, Artificial Sequence
  VIP-MIMETIC PEPTIDE
DWDTRGLWVA

SEQ ID NO: 667 - protein, 10 aa, Artificial Sequence
  VIP-MIMETIC PEPTIDE
SWGRDGLWIE

SEQ ID NO: 668 - protein, 10 aa, Artificial Sequence
  VIP-MIMETIC PEPTIDE
EWTDNGLWAL

SEQ ID NO: 669 - protein, 10 aa, Artificial Sequence
  VIP-MIMETIC PEPTIDE
SWDEKGLWSA

SEQ ID NO: 670 - protein, 10 aa, Artificial Sequence
  VIP-MIMETIC PEPTIDE
SWDSSGLWMD

SEQ ID NO: 671 - protein, 11 aa, Artificial Sequence
  IL-1 ANTAGONIST PEPTIDE
SHLYWQPYSVQ

SEQ ID NO: 672 - protein, 12 aa, Artificial Sequence
  IL-1 ANTAGONIST PEPTIDE
TLVYWQPYSLQT

SEQ ID NO: 673 - protein, 12 aa, Artificial Sequence
  IL-1 ANTAGONIST PEPTIDE
RGDYWQPYSVQS

SEQ ID NO: 674 - protein, 12 aa, Artificial Sequence
  IL-1 ANTAGONIST PEPTIDE
VHVYWQPYSVQT

SEQ ID NO: 675 - protein, 12 aa, Artificial Sequence
  IL-1 ANTAGONIST PEPTIDE
RLVYWQPYSVQT

SEQ ID NO: 676 - protein, 12 aa, Artificial Sequence
  IL-1 ANTAGONIST PEPTIDE
SRVWFQPYSLQS

SEQ ID NO: 677 - protein, 12 aa, Artificial Sequence
  IL-1 ANTAGONIST PEPTIDE
NMVYWQPYSIQT

SEQ ID NO: 678 - protein, 12 aa, Artificial Sequence
  IL-1 ANTAGONIST PEPTIDE
SVVFWQPYSVQT

SEQ ID NO: 679 - protein, 12 aa, Artificial Sequence
  IL-1 ANTAGONIST PEPTIDE
TFVYWQPYALPL

SEQ ID NO: 680 - protein, 12 aa, Artificial Sequence
  IL-1 ANTAGONIST PEPTIDE
TLVYWQPYSIQR

SEQ ID NO: 681 - protein, 12 aa, Artificial Sequence
  IL-1 ANTAGONIST PEPTIDE
RLVYWQPYSVQR

SEQ ID NO: 682 - protein, 12 aa, Artificial Sequence
  IL-1 ANTAGONIST PEPTIDE
SPVFWQPYSIQI

SEQ ID NO: 683 - protein, 12 aa, Artificial Sequence
  IL-1 ANTAGONIST PEPTIDE
WIEWWQPYSVQS

SEQ ID NO: 684 - protein, 12 aa, Artificial Sequence
  IL-1 ANTAGONIST PEPTIDE
SLIYWQPYSLQM

SEQ ID NO: 685 - protein, 12 aa, Artificial Sequence
  IL-1 ANTAGONIST PEPTIDE
TRLYWQPYSVQR

SEQ ID NO: 686 - protein, 12 aa, Artificial Sequence
  IL-1 ANTAGONIST PEPTIDE
RCDYWQPYSVQT

SEQ ID NO: 687 - protein, 12 aa, Artificial Sequence
  IL-1 ANTAGONIST PEPTIDE
MRVFWQPYSVQN

SEQ ID NO: 688 - protein, 12 aa, Artificial Sequence
  IL-1 ANTAGONIST PEPTIDE
KIVYWQPYSVQT

SEQ ID NO: 689 - protein, 12 aa, Artificial Sequence
  IL-1 ANTAGONIST PEPTIDE
RHLYWQPYSVQR

SEQ ID NO: 690 - protein, 12 aa, Artificial Sequence
  IL-1 ANTAGONIST PEPTIDE
ALVWWQPYSEQI

SEQ ID NO: 691 - protein, 12 aa, Artificial Sequence
  IL-1 ANTAGONIST PEPTIDE
SRVWFQPYSLQS

SEQ ID NO: 692 - protein, 10 aa, Artificial Sequence
  IL-1 ANTAGONIST PEPTIDE
WEQPYALPLE

SEQ ID NO: 693 - protein, 12 aa, Artificial Sequence
  IL-1 ANTAGONIST PEPTIDE
QLVWWQPYSVQR

SEQ ID NO: 694 - protein, 12 aa, Artificial Sequence
  IL-1 ANTAGONIST PEPTIDE
DLRYWQPYSVQV

SEQ ID NO: 695 - protein, 12 aa, Artificial Sequence
  IL-1 ANTAGONIST PEPTIDE
ELVWWQPYSLQL

SEQ ID NO: 696 - protein, 12 aa, Artificial Sequence
  IL-1 ANTAGONIST PEPTIDE
DLVWWQPYSVQW

SEQ ID NO: 697 - protein, 12 aa, Artificial Sequence
  IL-1 ANTAGONIST PEPTIDE
NGNYWQPYSFQV

SEQ ID NO: 698 - protein, 12 aa, Artificial Sequence
  IL-1 ANTAGONIST PEPTIDE
ELVYWQPYSIQR

SEQ ID NO: 699 - protein, 12 aa, Artificial Sequence
  IL-1 ANTAGONIST PEPTIDE
ELMYWQPYSVQE

SEQ ID NO: 700 - protein, 12 aa, Artificial Sequence
  IL-1 ANTAGONIST PEPTIDE
NLLYWQPYSMQD

SEQ ID NO: 701 - protein, 12 aa, Artificial Sequence
  IL-1 ANTAGONIST PEPTIDE
GYEWYQPYSVQR

SEQ ID NO: 702 - protein, 12 aa, Artificial Sequence
  IL-1 ANTAGONIST PEPTIDE
SRVWYQPYSVQR

SEQ ID NO: 703 - protein, 12 aa, Artificial Sequence
  IL-1 ANTAGONIST PEPTIDE
LSEQYQPYSVQR

SEQ ID NO: 704 - protein, 12 aa, Artificial Sequence
  IL-1 ANTAGONIST PEPTIDE
GGGWWQPYSVQR

SEQ ID NO: 705 - protein, 12 aa, Artificial Sequence
  IL-1 ANTAGONIST PEPTIDE
VGRWYQPYSVQR

SEQ ID NO: 706 - protein, 12 aa, Artificial Sequence
  IL-1 ANTAGONIST PEPTIDE
VHVYWQPYSVQR

SEQ ID NO: 707 - protein, 12 aa, Artificial Sequence
  IL-1 ANTAGONIST PEPTIDE
QARWYQPYSVQR

SEQ ID NO: 708 - protein, 12 aa, Artificial Sequence
  IL-1 ANTAGONIST PEPTIDE
VHVYWQPYSVQT

SEQ ID NO: 709 - protein, 12 aa, Artificial Sequence
  IL-1 ANTAGONIST PEPTIDE
RSVYWQPYSVQR

SEQ ID NO: 710 - protein, 12 aa, Artificial Sequence
  IL-1 ANTAGONIST PEPTIDE
TRVWFQPYSVQR

SEQ ID NO: 711 - protein, 12 aa, Artificial Sequence
  IL-1 ANTAGONIST PEPTIDE
GRIWFQPYSVQR

SEQ ID NO: 712 - protein, 12 aa, Artificial Sequence
  IL-1 ANTAGONIST PEPTIDE
GRVWFQPYSVQR

SEQ ID NO: 713 - protein, 12 aa, Artificial Sequence
  IL-1 ANTAGONIST PEPTIDE
ARTWYQPYSVQR

SEQ ID NO: 714 - protein, 12 aa, Artificial Sequence
  IL-1 ANTAGONIST PEPTIDE
ARVWWQPYSVQM

SEQ ID NO: 715 - protein, 12 aa, Artificial Sequence
  IL-1 ANTAGONIST PEPTIDE
RLMFYQPYSVQR

SEQ ID NO: 716 - protein, 12 aa, Artificial Sequence
  IL-1 ANTAGONIST PEPTIDE
ESMWYQPYSVQR

SEQ ID NO: 717 - protein, 12 aa, Artificial Sequence
  IL-1 ANTAGONIST PEPTIDE
HFGWWQPYSVHM

SEQ ID NO: 718 - protein, 12 aa, Artificial Sequence
  IL-1 ANTAGONIST PEPTIDE
ARFWWQPYSVQR

SEQ ID NO: 719 - protein, 12 aa, Artificial Sequence
  IL-1 ANTAGONIST PEPTIDE
RLVYWQPYAPIY

SEQ ID NO: 720 - protein, 12 aa, Artificial Sequence
  IL-1 ANTAGONIST PEPTIDE
RLVYWQPYSYQT

SEQ ID NO: 721 - protein, 12 aa, Artificial Sequence
  IL-1 ANTAGONIST PEPTIDE
RLVYWQPYSLPI

SEQ ID NO: 722 - protein, 12 aa, Artificial Sequence
  IL-1 ANTAGONIST PEPTIDE
RLVYWQPYSVQA

SEQ ID NO: 723 - protein, 12 aa, Artificial Sequence
  IL-1 ANTAGONIST PEPTIDE
SRVWYQPYAKGL

SEQ ID NO: 724 - protein, 12 aa, Artificial Sequence
  IL-1 ANTAGONIST PEPTIDE
SRVWYQPYAQGL

SEQ ID NO: 725 - protein, 12 aa, Artificial Sequence
  IL-1 ANTAGONIST PEPTIDE
SRVWYQPYAMPL

SEQ ID NO: 726 - protein, 12 aa, Artificial Sequence
  IL-1 ANTAGONIST PEPTIDE
SRVWYQPYSVQA

SEQ ID NO: 727 - protein, 12 aa, Artificial Sequence
  IL-1 ANTAGONIST PEPTIDE
SRVWYQPYSLGL

SEQ ID NO: 728 - protein, 12 aa, Artificial Sequence
  IL-1 ANTAGONIST PEPTIDE
SRVWYQPYAREL

SEQ ID NO: 729 - protein, 12 aa, Artificial Sequence
  IL-1 ANTAGONIST PEPTIDE
SRVWYQPYSRQP

SEQ ID NO: 730 - protein, 12 aa, Artificial Sequence
  IL-1 ANTAGONIST PEPTIDE
SRVWYQPYFVQP

SEQ ID NO: 731 - protein, 12 aa, Artificial Sequence
  IL-1 ANTAGONIST PEPTIDE
EYEWYQPYALPL

SEQ ID NO: 732 - protein, 12 aa, Artificial Sequence
  IL-1 ANTAGONIST PEPTIDE
IPEYWQPYALPL

SEQ ID NO: 733 - protein, 12 aa, Artificial Sequence
  IL-1 ANTAGONIST PEPTIDE
SRIWWQPYALPL

SEQ ID NO: 734 - protein, 12 aa, Artificial Sequence
  IL-1 ANTAGONIST PEPTIDE
DPLFWQPYALPL

SEQ ID NO: 735 - protein, 12 aa, Artificial Sequence
  IL-1 ANTAGONIST PEPTIDE
SRQWVQPYALPL

SEQ ID NO: 736 - protein, 12 aa, Artificial Sequence
  IL-1 ANTAGONIST PEPTIDE
IRSWWQPYALPL

SEQ ID NO: 737 - protein, 11 aa, Artificial Sequence
  IL-1 ANTAGONIST PEPTIDE
RGYWQPYALPL

SEQ ID NO: 738 - protein, 12 aa, Artificial Sequence
  IL-1 ANTAGONIST PEPTIDE
RLLWVQPYALPL

SEQ ID NO: 739 - protein, 12 aa, Artificial Sequence
  IL-1 ANTAGONIST PEPTIDE
EYRWFQPYALPL

SEQ ID NO: 740 - protein, 12 aa, Artificial Sequence
  IL-1 ANTAGONIST PEPTIDE
DAYWVQPYALPL

SEQ ID NO: 741 - protein, 12 aa, Artificial Sequence
  IL-1 ANTAGONIST PEPTIDE
WSGYFQPYALPL

SEQ ID NO: 742 - protein, 12 aa, Artificial Sequence
  IL-1 ANTAGONIST PEPTIDE
NIEFWQPYALPL

SEQ ID NO: 743 - protein, 12 aa, Artificial Sequence
  IL-1 ANTAGONIST PEPTIDE
TRDWVQPYALPL

SEQ ID NO: 744 - protein, 12 aa, Artificial Sequence
  IL-1 ANTAGONIST PEPTIDE
DSSWYQPYALPL

SEQ ID NO: 745 - protein, 12 aa, Artificial Sequence
  IL-1 ANTAGONIST PEPTIDE
IGNWYQPYALPL

SEQ ID NO: 746 - protein, 12 aa, Artificial Sequence
  IL-1 ANTAGONIST PEPTIDE
NLRWDQPYALPL

SEQ ID NO: 747 - protein, 12 aa, Artificial Sequence
  IL-1 ANTAGONIST PEPTIDE
LPEFWQPYALPL

SEQ ID NO: 748 - protein, 12 aa, Artificial Sequence
  IL-1 ANTAGONIST PEPTIDE
DSYWWQPYALPL

SEQ ID NO: 749 - protein, 12 aa, Artificial Sequence
  IL-1 ANTAGONIST PEPTIDE
RSQYYQPYALPL

SEQ ID NO: 750 - protein, 12 aa, Artificial Sequence
  IL-1 ANTAGONIST PEPTIDE
ARFWLQPYALPL

SEQ ID NO: 751 - protein, 12 aa, Artificial Sequence
  IL-1 ANTAGONIST PEPTIDE
NSYFWQPYALPL

SEQ ID NO: 752 - protein, 12 aa, Artificial Sequence
  IL-1 ANTAGONIST PEPTIDE
RFMYWQPYSVQR

SEQ ID NO: 753 - protein, 12 aa, Artificial Sequence
  IL-1 ANTAGONIST PEPTIDE
AHLFWQPYSVQR

SEQ ID NO: 754 - protein, 9 aa, Artificial Sequence
  IL-1 ANTAGONIST PEPTIDE
WWQPYALPL

SEQ ID NO: 755 - protein, 9 aa, Artificial Sequence
  IL-1 ANTAGONIST PEPTIDE
YYQPYALPL

SEQ ID NO: 756 - protein, 9 aa, Artificial Sequence
  IL-1 ANTAGONIST PEPTIDE
YFQPYALGL

SEQ ID NO: 757 - protein, 10 aa, Artificial Sequence
  IL-1 ANTAGONIST PEPTIDE
YWYQPYALPL

SEQ ID NO: 758 - protein, 10 aa, Artificial Sequence
  IL-1 ANTAGONIST PEPTIDE
RWWQPYATPL

SEQ ID NO: 759 - protein, 10 aa, Artificial Sequence
  IL-1 ANTAGONIST PEPTIDE
GWYQPYALGF

SEQ ID NO: 760 - protein, 10 aa, Artificial Sequence
  IL-1 ANTAGONIST PEPTIDE
YWYQPYALGL

SEQ ID NO: 761 - protein, 10 aa, Artificial Sequence
  IL-1 ANTAGONIST PEPTIDE
IWYQPYAMPL

SEQ ID NO: 762 - protein, 10 aa, Artificial Sequence
  IL-1 ANTAGONIST PEPTIDE
SNMQPYQRLS

SEQ ID NO: 763 - protein, 20 aa, Artificial Sequence
  IL-1 ANTAGONIST PEPTIDE
TFVYWQPYAVGLPAAETACN

SEQ ID NO: 764 - protein, 20 aa, Artificial Sequence
  IL-1 ANTAGONIST PEPTIDE
TFVYWQPYSVQMTITGKVTM

SEQ ID NO: 765 - protein, 20 aa, Artificial Sequence
  IL-1 ANTAGONIST PEPTIDE
  misc_feature (12, 13)..(16): Xaa = any amino acid
TFVYWQPYSSHXXVPXGFPL

SEQ ID NO: 766 - protein, 20 aa, Artificial Sequence
  IL-1 ANTAGONIST PEPTIDE
TFVYWQPYYGNPQWAIHVRH

SEQ ID NO: 767 - protein, 20 aa, Artificial Sequence
  IL-1 ANTAGONIST PEPTIDE
TFVYWQPYVLLELPEGAVRA

SEQ ID NO: 768 - protein, 20 aa, Artificial Sequence
  IL-1 ANTAGONIST PEPTIDE
TFVYWQPYVDYVWPIPIAQV

SEQ ID NO: 769 - protein, 11 aa, Artificial Sequence
  IL-1 ANTAGONIST PEPTIDE
GWYQPYVDGWR

SEQ ID NO: 770 - protein, 12 aa, Artificial Sequence
  IL-1 ANTAGONIST PEPTIDE
RWEQPYVKDGWS

SEQ ID NO: 771 - protein, 12 aa, Artificial Sequence
  IL-1 ANTAGONIST PEPTIDE
EWYQPYALGWAR

SEQ ID NO: 772 - protein, 10 aa, Artificial Sequence
  IL-1 ANTAGONIST PEPTIDE
GWWQPYARGL

SEQ ID NO: 773 - protein, 12 aa, Artificial Sequence
  IL-1 ANTAGONIST PEPTIDE
LFEQPYAKALGL

SEQ ID NO: 774 - protein, 12 aa, Artificial Sequence
  IL-1 ANTAGONIST PEPTIDE
GWEQPYARGLAG

SEQ ID NO: 775 - protein, 12 aa, Artificial Sequence
  IL-1 ANTAGONIST PEPTIDE
AWVQPYATPLDE

SEQ ID NO: 776 - protein, 12 aa, Artificial Sequence
  IL-1 ANTAGONIST PEPTIDE
MWYQPYSSQPAE

SEQ ID NO: 777 - protein, 12 aa, Artificial Sequence
  IL-1 ANTAGONIST PEPTIDE
GWTQPYSQQGEV

SEQ ID NO: 778 - protein, 12 aa, Artificial Sequence
  IL-1 ANTAGONIST PEPTIDE
DWFQPYSIQSDE

SEQ ID NO: 779 - protein, 11 aa, Artificial Sequence
  IL-1 ANTAGONIST PEPTIDE
PWIQPYARGFG

SEQ ID NO: 780 - protein, 12 aa, Artificial Sequence
  IL-1 ANTAGONIST PEPTIDE
RPLYWQPYSVQV

SEQ ID NO: 781 - protein, 12 aa, Artificial Sequence
  IL-1 ANTAGONIST PEPTIDE
TLIYWQPYSVQI

SEQ ID NO: 782 - protein, 12 aa, Artificial Sequence
  IL-1 ANTAGONIST PEPTIDE
RFDYWQPYSDQT

SEQ ID NO: 783 - protein, 12 aa, Artificial Sequence
  IL-1 ANTAGONIST PEPTIDE
WHQFVQPYALPL

SEQ ID NO: 784 - protein, 17 aa, Artificial Sequence
  IL-1 ANTAGONIST PEPTIDE
EWDSVYWQPYSVQTLLR

SEQ ID NO: 785 - protein, 17 aa, Artificial Sequence
  IL-1 ANTAGONIST PEPTIDE
WEQNVYWQPYSVQSFAD

SEQ ID NO: 786 - protein, 16 aa, Artificial Sequence
  IL-1 ANTAGONIST PEPTIDE
SDVVYWQPYSVQSLEM

SEQ ID NO: 787 - protein, 17 aa, Artificial Sequence
  IL-1 ANTAGONIST PEPTIDE
YYDGVYWQPYSVQVMPA

SEQ ID NO: 788 - protein, 12 aa, Artificial Sequence
  IL-1 ANTAGONIST PEPTIDE
SDIWYQPYALPL

SEQ ID NO: 789 - protein, 12 aa, Artificial Sequence
  IL-1 ANTAGONIST PEPTIDE
QRIWWQPYALPL

SEQ ID NO: 790 - protein, 12 aa, Artificial Sequence
  IL-1 ANTAGONIST PEPTIDE
SRIWWQPYALPL

SEQ ID NO: 791 - protein, 12 aa, Artificial Sequence
  IL-1 ANTAGONIST PEPTIDE
RSLYWQPYALPL

SEQ ID NO: 792 - protein, 12 aa, Artificial Sequence
  IL-1 ANTAGONIST PEPTIDE
TIIWEQPYALPL

SEQ ID NO: 793 - protein, 12 aa, Artificial Sequence
  IL-1 ANTAGONIST PEPTIDE
WETWYQPYALPL

SEQ ID NO: 794 - protein, 12 aa, Artificial Sequence
  IL-1 ANTAGONIST PEPTIDE
SYDWEQPYALPL

SEQ ID NO: 795 - protein, 12 aa, Artificial Sequence
  IL-1 ANTAGONIST PEPTIDE
SRIWCQPYALPL

SEQ ID NO: 796 - protein, 12 aa, Artificial Sequence
  IL-1 ANTAGONIST PEPTIDE
EIMFWQPYALPL

SEQ ID NO: 797 - protein, 12 aa, Artificial Sequence
  IL-1 ANTAGONIST PEPTIDE
DYVWQQPYALPL

SEQ ID NO: 798 - protein, 15 aa, Artificial Sequence
  IL-1 ANTAGONIST PEPTIDE
MDLLVQWYQPYALPL

SEQ ID NO: 799 - protein, 15 aa, Artificial Sequence
  IL-1 ANTAGONIST PEPTIDE
GSKVILWYQPYALPL

SEQ ID NO: 800 - protein, 15 aa, Artificial Sequence
  IL-1 ANTAGONIST PEPTIDE
RQGANIWYQPYALPL

SEQ ID NO: 801 - protein, 15 aa, Artificial Sequence
  IL-1 ANTAGONIST PEPTIDE
GGGDEPWYQPYALPL

SEQ ID NO: 802 - protein, 15 aa, Artificial Sequence
  IL-1 ANTAGONIST PEPTIDE
SQLERTWYQPYALPL

SEQ ID NO: 803 - protein, 15 aa, Artificial Sequence
  IL-1 ANTAGONIST PEPTIDE
ETWVREWYQPYALPL

SEQ ID NO: 804 - protein, 15 aa, Artificial Sequence
  IL-1 ANTAGONIST PEPTIDE
KKGSTQWYQPYALPL

SEQ ID NO: 805 - protein, 15 aa, Artificial Sequence
  IL-1 ANTAGONIST PEPTIDE
LQARMNWYQPYALPL

SEQ ID NO: 806 - protein, 15 aa, Artificial Sequence
  IL-1 ANTAGONIST PEPTIDE
EPRSQKWYQPYALPL

SEQ ID NO: 807 - protein, 15 aa, Artificial Sequence
  IL-1 ANTAGONIST PEPTIDE
VKQKWRWYQPYALPL

SEQ ID NO: 808 - protein, 15 aa, Artificial Sequence
  IL-1 ANTAGONIST PEPTIDE
LRRHDVWYQPYALPL

SEQ ID NO: 809 - protein, 15 aa, Artificial Sequence
  IL-1 ANTAGONIST PEPTIDE
RSTASIWYQPYALPL

SEQ ID NO: 810 - protein, 15 aa, Artificial Sequence
  IL-1 ANTAGONIST PEPTIDE
ESKEDQWYQPYALPL

SEQ ID NO: 811 - protein, 15 aa, Artificial Sequence
  IL-1 ANTAGONIST PEPTIDE
EGLTMKWYQPYALPL

SEQ ID NO: 812 - protein, 15 aa, Artificial Sequence
  IL-1 ANTAGONIST PEPTIDE
EGSREGWYQPYALPL

SEQ ID NO: 813 - protein, 12 aa, Artificial Sequence
  IL-1 ANTAGONIST PEPTIDE
VIEWWQPYALPL

SEQ ID NO: 814 - protein, 12 aa, Artificial Sequence
  IL-1 ANTAGONIST PEPTIDE
VWYWEQPYALPL

SEQ ID NO: 815 - protein, 12 aa, Artificial Sequence
  IL-1 ANTAGONIST PEPTIDE
ASEWWQPYALPL

SEQ ID NO: 816 - protein, 12 aa, Artificial Sequence
  IL-1 ANTAGONIST PEPTIDE
FYEWWQPYALPL

SEQ ID NO: 817 - protein, 12 aa, Artificial Sequence
  IL-1 ANTAGONIST PEPTIDE
EGWWVQPYALPL

SEQ ID NO: 818 - protein, 12 aa, Artificial Sequence
  IL-1 ANTAGONIST PEPTIDE
WGEWLQPYALPL

SEQ ID NO: 819 - protein, 12 aa, Artificial Sequence
  IL-1 ANTAGONIST PEPTIDE
DYVWEQPYALPL

SEQ ID NO: 820 - protein, 12 aa, Artificial Sequence
  IL-1 ANTAGONIST PEPTIDE
AHTWWQPYALPL

SEQ ID NO: 821 - protein, 12 aa, Artificial Sequence
  IL-1 ANTAGONIST PEPTIDE
FIEWFQPYALPL

SEQ ID NO: 822 - protein, 12 aa, Artificial Sequence
  IL-1 ANTAGONIST PEPTIDE
WLAWEQPYALPL

SEQ ID NO: 823 - protein, 12 aa, Artificial Sequence
  IL-1 ANTAGONIST PEPTIDE
VMEWWQPYALPL

SEQ ID NO: 824 - protein, 11 aa, Artificial Sequence
  IL-1 ANTAGONIST PEPTIDE
ERMWQPYALPL

SEQ ID NO: 825 - protein, 12 aa, Artificial Sequence
  IL-1 ANTAGONIST PEPTIDE
  misc_feature (2, 3, 5)..(6): Xaa = any amino acid
NXXWXXPYALPL

SEQ ID NO: 826 - protein, 12 aa, Artificial Sequence
  IL-1 ANTAGONIST PEPTIDE
WGNWYQPYALPL

SEQ ID NO: 827 - protein, 12 aa, Artificial Sequence
  IL-1 ANTAGONIST PEPTIDE
TLYWEQPYALPL

SEQ ID NO: 828 - protein, 12 aa, Artificial Sequence
  IL-1 ANTAGONIST PEPTIDE
VWRWEQPYALPL

SEQ ID NO: 829 - protein, 11 aa, Artificial Sequence
  IL-1 ANTAGONIST PEPTIDE
LLWTQPYALPL

SEQ ID NO: 830 - protein, 12 aa, Artificial Sequence
  IL-1 ANTAGONIST PEPTIDE
  misc_feature (5)..(6): Xaa = any amino acid
SRIWXXPYALPL

SEQ ID NO: 831 - protein, 12 aa, Artificial Sequence
  IL-1 ANTAGONIST PEPTIDE
SDIWYQPYALPL

SEQ ID NO: 832 - protein, 12 aa, Artificial Sequence
  IL-1 ANTAGONIST PEPTIDE
  misc_feature (5)..(6): Xaa = any amino acid
WGYYXXPYALPL

SEQ ID NO: 833 - protein, 12 aa, Artificial Sequence
  IL-1 ANTAGONIST PEPTIDE
TSGWYQPYALPL

SEQ ID NO: 834 - protein, 12 aa, Artificial Sequence
  IL-1 ANTAGONIST PEPTIDE
  misc_feature (5)..(6): Xaa = any amino acid
VHPYXXPYALPL

SEQ ID NO: 835 - protein, 12 aa, Artificial Sequence
  IL-1 ANTAGONIST PEPTIDE
EHSYFQPYALPL

SEQ ID NO: 836 - protein, 12 aa, Artificial Sequence
  IL-1 ANTAGONIST PEPTIDE
  misc_feature (1)..(2): Xaa = any amino acid
XXIWYQPYALPL

SEQ ID NO: 837 - protein, 12 aa, Artificial Sequence
  IL-1 ANTAGONIST PEPTIDE
AQLHSQPYALPL

SEQ ID NO: 838 - protein, 12 aa, Artificial Sequence
  IL-1 ANTAGONIST PEPTIDE
WANWFQPYALPL

SEQ ID NO: 839 - protein, 12 aa, Artificial Sequence
  IL-1 ANTAGONIST PEPTIDE
SRLYSQPYALPL

SEQ ID NO: 840 - protein, 12 aa, Artificial Sequence
  IL-1 ANTAGONIST PEPTIDE
GVTFSQPYALPL

SEQ ID NO: 841 - protein, 12 aa, Artificial Sequence
  IL-1 ANTAGONIST PEPTIDE
SIVWSQPYALPL

SEQ ID NO: 842 - protein, 12 aa, Artificial Sequence
  IL-1 ANTAGONIST PEPTIDE
SRDLVQPYALPL

SEQ ID NO: 843 - protein, 17 aa, Artificial Sequence
  IL-1 ANTAGONIST PEPTIDE
HWGHVYWQPYSVQDDLG

SEQ ID NO: 844 - protein, 17 aa, Artificial Sequence
  IL-1 ANTAGONIST PEPTIDE
SWHSVYWQPYSVQSVPE

SEQ ID NO: 845 - protein, 17 aa, Artificial Sequence
  IL-1 ANTAGONIST PEPTIDE
WRDSVYWQPYSVQPESA

SEQ ID NO: 846 - protein, 17 aa, Artificial Sequence
  IL-1 ANTAGONIST PEPTIDE
TWDAVYWQPYSVQKWLD

SEQ ID NO: 847 - protein, 17 aa, Artificial Sequence
  IL-1 ANTAGONIST PEPTIDE
TPPWVYWQPYSVQSLDP

SEQ ID NO: 848 - protein, 17 aa, Artificial Sequence
  IL-1 ANTAGONIST PEPTIDE
YWSSVYWQPYSVQSVHS

SEQ ID NO: 849 - protein, 10 aa, Artificial Sequence
  IL-1 ANTAGONIST PEPTIDE
YWYQPYALGL

SEQ ID NO: 850 - protein, 10 aa, Artificial Sequence
  IL-1 ANTAGONIST PEPTIDE
YWYQPYALPL

SEQ ID NO: 851 - protein, 10 aa, Artificial Sequence
  IL-1 ANTAGONIST PEPTIDE
EWIQPYATGL

SEQ ID NO: 852 - protein, 10 aa, Artificial Sequence
  IL-1 ANTAGONIST PEPTIDE
NWEQPYAKPL

SEQ ID NO: 853 - protein, 10 aa, Artificial Sequence
  IL-1 ANTAGONIST PEPTIDE
AFYQPYALPL

SEQ ID NO: 854 - protein, 10 aa, Artificial Sequence
  IL-1 ANTAGONIST PEPTIDE
FLYQPYALPL

SEQ ID NO: 855 - protein, 10 aa, Artificial Sequence
  IL-1 ANTAGONIST PEPTIDE
VCKQPYLEWC

SEQ ID NO: 856 - protein, 21 aa, Artificial Sequence
  IL-1 ANTAGONIST PEPTIDE
ETPFTWEESNAYYWQPYALPL

SEQ ID NO: 857 - protein, 21 aa, Artificial Sequence
  IL-1 ANTAGONIST PEPTIDE
QGWLTWQDSVDMYWQPYALPL

SEQ ID NO: 858 - protein, 21 aa, Artificial Sequence
  IL-1 ANTAGONIST PEPTIDE
FSEAGYTWPENTYWQPYALPL

SEQ ID NO: 859 - protein, 21 aa, Artificial Sequence
  IL-1 ANTAGONIST PEPTIDE
TESPGGLDWAKIYWQPYALPL

SEQ ID NO: 860 - protein, 21 aa, Artificial Sequence
  IL-1 ANTAGONIST PEPTIDE
DGYDRWRQSGERYWQPYALPL

SEQ ID NO: 861 - protein, 21 aa, Artificial Sequence
  IL-1 ANTAGONIST PEPTIDE
TANVSSFEWTPGYWQPYALPL

SEQ ID NO: 862 - protein, 21 aa, Artificial Sequence
  IL-1 ANTAGONIST PEPTIDE
SVGEDHNFWTSEYWQPYALPL

SEQ ID NO: 863 - protein, 21 aa, Artificial Sequence
  IL-1 ANTAGONIST PEPTIDE
MNDQTSEVSTFPYWQPYALPL

SEQ ID NO: 864 - protein, 21 aa, Artificial Sequence
  IL-1 ANTAGONIST PEPTIDE
SWSEAFEQPRNLYWQPYALPL

SEQ ID NO: 865 - protein, 21 aa, Artificial Sequence
  IL-1 ANTAGONIST PEPTIDE
QYAEPSALNDWGYWQPYALPL

SEQ ID NO: 866 - protein, 21 aa, Artificial Sequence
  IL-1 ANTAGONIST PEPTIDE
NGDWATADWSNYYWQPYALPL

SEQ ID NO: 867 - protein, 15 aa, Artificial Sequence
  IL-1 ANTAGONIST PEPTIDE
THDEHIYWQPYALPL

SEQ ID NO: 868 - protein, 21 aa, Artificial Sequence
  IL-1 ANTAGONIST PEPTIDE
MLEKTYTTWTPGYWQPYALPL

SEQ ID NO: 869 - protein, 20 aa, Artificial Sequence
  IL-1 ANTAGONIST PEPTIDE
WSDPLTRDADLYWQPYALPL

SEQ ID NO: 870 - protein, 21 aa, Artificial Sequence
  IL-1 ANTAGONIST PEPTIDE
SDAFTTQDSQAMYWQPYALPL

SEQ ID NO: 871 - protein, 21 aa, Artificial Sequence
  IL-1 ANTAGONIST PEPTIDE
GDDAAWRTDSLTYWQPYALPL

SEQ ID NO: 872 - protein, 21 aa, Artificial Sequence
  IL-1 ANTAGONIST PEPTIDE
AIIRQLYRWSEMYWQPYALPL

SEQ ID NO: 873 - protein, 21 aa, Artificial Sequence
  IL-1 ANTAGONIST PEPTIDE
ENTYSPNWADSMYWQPYALPL

SEQ ID NO: 874 - protein, 21 aa, Artificial Sequence
  IL-1 ANTAGONIST PEPTIDE
MNDQTSEVSTFPYWQPYALPL

SEQ ID NO: 875 - protein, 21 aa, Artificial Sequence
  IL-1 ANTAGONIST PEPTIDE
SVGEDHNFWTSEYWQPYALPL

SEQ ID NO: 876 - protein, 21 aa, Artificial Sequence
  IL-1 ANTAGONIST PEPTIDE
QTPFTWEESNAYYWQPYALPL

SEQ ID NO: 877 - protein, 21 aa, Artificial Sequence
  IL-1 ANTAGONIST PEPTIDE
ENPFTWQESNAYYWQPYALPL

SEQ ID NO: 878 - protein, 21 aa, Artificial Sequence
  IL-1 ANTAGONIST PEPTIDE
VTPFTWEDSNVFYWQPYALPL

SEQ ID NO: 879 - protein, 21 aa, Artificial Sequence
  IL-1 ANTAGONIST PEPTIDE
QIPFTWEQSNAYYWQPYALPL

SEQ ID NO: 880 - protein, 21 aa, Artificial Sequence
  IL-1 ANTAGONIST PEPTIDE
QAPLTWQESAAYYWQPYALPL

SEQ ID NO: 881 - protein, 21 aa, Artificial Sequence
  IL-1 ANTAGONIST PEPTIDE
EPTFTWEESKATYWQPYALPL

SEQ ID NO: 882 - protein, 21 aa, Artificial Sequence
  IL-1 ANTAGONIST PEPTIDE
TTTLTWEESNAYYWQPYALPL

SEQ ID NO: 883 - protein, 21 aa, Artificial Sequence
  IL-1 ANTAGONIST PEPTIDE
ESPLTWEESSALYWQPYALPL

SEQ ID NO: 884 - protein, 21 aa, Artificial Sequence
  IL-1 ANTAGONIST PEPTIDE
ETPLTWEESNAYYWQPYALPL

SEQ ID NO: 885 - protein, 21 aa, Artificial Sequence
  IL-1 ANTAGONIST PEPTIDE
EATFTWAESNAYYWQPYALPL

SEQ ID NO: 886 - protein, 21 aa, Artificial Sequence
  IL-1 ANTAGONIST PEPTIDE
EALFTWKESTAYYWQPYALPL

SEQ ID NO: 887 - protein, 20 aa, Artificial Sequence
  IL-1 ANTAGONIST PEPTIDE
STPTWEESNAYYWQPYALPL

SEQ ID NO: 888 - protein, 21 aa, Artificial Sequence
  IL-1 ANTAGONIST PEPTIDE
ETPFTWEESNAYYWQPYALPL

SEQ ID NO: 889 - protein, 21 aa, Artificial Sequence
  IL-1 ANTAGONIST PEPTIDE
KAPFTWEESQAYYWQPYALPL

SEQ ID NO: 890 - protein, 21 aa, Artificial Sequence
  IL-1 ANTAGONIST PEPTIDE
STSFTWEESNAYYWQPYALPL

SEQ ID NO: 891 - protein, 21 aa, Artificial Sequence
  IL-1 ANTAGONIST PEPTIDE
DSTFTWEESNAYYWQPYALPL

SEQ ID NO: 892 - protein, 21 aa, Artificial Sequence
  IL-1 ANTAGONIST PEPTIDE
YIPFTWEESNAYYWQPYALPL

SEQ ID NO: 893 - protein, 21 aa, Artificial Sequence
  IL-1 ANTAGONIST PEPTIDE
QTAFTWEESNAYYWQPYALPL

SEQ ID NO: 894 - protein, 21 aa, Artificial Sequence
  IL-1 ANTAGONIST PEPTIDE
ETLFTWEESNATYWQPYALPL

SEQ ID NO: 895 - protein, 21 aa, Artificial Sequence
  IL-1 ANTAGONIST PEPTIDE
VSSFTWEESNAYYWQPYALPL

SEQ ID NO: 896 - protein, 7 aa, Artificial Sequence
  IL-1 ANTAGONIST PEPTIDE
QPYALPL

SEQ ID NO: 897 - protein, 11 aa, Artificial Sequence
  IL-1 ANTAGONIST PEPTIDE
  misc_feature (1)..(1): Position 1, Xaa is a phosphotyrosyl residue
  misc_feature (2)..(2): Position 2, Xaa is a 1-napthylalanyl residue
  misc_feature (6)..(6): Position 6, Xaa is an azetidine residue
XXPYQXYALPL

SEQ ID NO: 898 - protein, 21 aa, Artificial Sequence
  IL-1 ANTAGONIST PEPTIDE
TANVSSFEWTPGYWQPYALPL

SEQ ID NO: 899 - protein, 15 aa, Artificial Sequence
  IL-1 ANTAGONIST PEPTIDE
FEWTPGYWQPYALPL

SEQ ID NO: 900 - protein, 15 aa, Artificial Sequence
  IL-1 ANTAGONIST PEPTIDE
  misc_feature (10)..(10): Position 10, Xaa is an azetidine residue
FEWTPGYWQXYALPL

SEQ ID NO: 901 - protein, 15 aa, Artificial Sequence
  IL-1 ANTAGONIST PEPTIDE
  misc_feature (10)..(10): Position 10, Xaa is an azetidine residue
FEWTPGYYQXYALPL

SEQ ID NO: 902 - protein, 21 aa, Artificial Sequence
  IL-1 ANTAGONIST PEPTIDE
ETPFTWEESNAYYWQPYALPL

SEQ ID NO: 903 - protein, 18 aa, Artificial Sequence
  IL-1 ANTAGONIST PEPTIDE
  misc_feature (13)..(13): Position 13, Xaa is an azetidine residue
FTWEESNAYYWQXYALPL

SEQ ID NO: 904 - protein, 16 aa, Artificial Sequence
  IL-1 ANTAGONIST PEPTIDE
ADVLYWQPYAPVTLWV

SEQ ID NO: 905 - protein, 17 aa, Artificial Sequence
  IL-1 ANTAGONIST
GDVAEYWQPYALPLTSL

SEQ ID NO: 906 - protein, 18 aa, Artificial Sequence
  IL-1 ANTAGONIST PEPTIDE
SWTDYGYWQPYALPISGL

SEQ ID NO: 907 - protein, 8 aa, Artificial Sequence
  IL-1 ANTAGONIST PEPTIDE
  misc_feature (1, 2, 7)..(8): Xaa is any amino acid
  misc_feature (4)..(4): Position 4, Xaa is prolyl or an azetidine residue
  misc_feature (6)..(6): Position 6, Xaa is S, A, V or L
XXQXYXXX

SEQ ID NO: 908 - protein, 8 aa, Artificial Sequence
  IL-1 ANTAGONIST PEPTIDE
  misc_feature (1)..(1): Position 1, Xaa is Y, W or F
  misc_feature (2, 7)..(8): Xaa is any amino acid
  misc_feature (4)..(4): Position 4, Xaa is prolyl or an azetidine residue
  misc_feature (6)..(6): Position 6, Xaa is S, A, V or L
XXQXYXXX

SEQ ID NO: 909 - protein, 8 aa, Artificial Sequence
  IL-1 ANTAGONIST PEPTIDE
  misc_feature (1)..(1): Position 1, Xaa is Y, W or F
  misc_feature (2)..(2): Position 2, Xaa is E, F, V, W or Y
  misc_feature (4)..(4): Position 4, Xaa is prolyl or an azetidine residue
  misc_feature (6)..(6): Position 6, Xaa is S, A, V or L
  misc_feature (7)..(7): Position 7, Xaa is M, F, V, R, Q, K, T, S, D, L, I or E
  misc_feature (8)..(8): Position 8, Xaa is E, L, W, V, H, I, G, A, D, L, Y, N, Q or P
XXGXYXXX

SEQ ID NO: 910 - protein, 9 aa, Artificial Sequence
  IL-1 ANTAGONIST PEPTIDE
  misc_feature (1)..(1): Position 1, Xaa is V, L, I, E, P, G, Y, M, T or D
  misc_feature (2)..(2): Position 2, Xaa is Y, W or F
  misc_feature (3)..(3): Position 3, Xaa is E, F, V, W or Y
  misc_feature (5)..(5): Position 5, Xaa is prolyl or an azetidine residue;
  misc_feature (7)..(7): Position 7, Xaa is S, A, V or L
  misc_feature (8)..(8): Position 8, Xaa is M, F, V, R, Q, K, T, S, D, L, I or E;
  misc_feature (9)..(9): Position 9, Xaa is E, L, W, V, H, I, G, A, D, L, Y, N, Q or P
XXXQXYXXX

SEQ ID NO: 911 - protein, 15 aa, Artificial Sequence
  IL-1 ANTAGONIST PEPTIDE
FEWTPGYWQPYALPL

SEQ ID NO: 912 - protein, 15 aa, Artificial Sequence
  IL-1 ANTAGONIST PEPTIDE
  misc_feature (10)..(10): Xaa = any amino acid
FEWTPGYWQXYALPL

SEQ ID NO: 913 - protein, 15 aa, Artificial Sequence
  IL-1 ANTAGONIST PEPTIDE
FEWTPGWYQPYALPL

SEQ ID NO: 914 - protein, 15 aa, Artificial Sequence
  IL-1 ANTAGONIST PEPTIDE
  misc_feature (10)..(10): Position 10, Xaa is an azetidine residue
FEWTPGWYQXYALPL

SEQ ID NO: 915 - protein, 15 aa, Artificial Sequence
  IL-1 ANTAGONIST PEPTIDE
FEWTPGYYQPYALPL

SEQ ID NO: 916 - protein, 15 aa, Artificial Sequence
  IL-1 ANTAGONIST PEPTIDE
  misc_feature (10)..(10): Position 10, Xaa is an azetidine residue
FEWTPGYYQXYALPL

SEQ ID NO: 917 - protein, 21 aa, Artificial Sequence
  IL-1 ANTAGONIST PEPTIDE
  misc_feature (1)..(1): Position 1, Xaa is A, D, E, F, G, K, Q, S, T, V or Y
  misc_feature (2)..(2): Position 2, Xaa is A, D, G, I, N, P, S, T, V or W
  misc_feature (3)..(3): Position 3, Xaa is A, D, G, L, N, P, S, T, W or Y
  misc_feature (4)..(4): Position 4, Xaa is A, D, E, F, L, N, R, V or Y
  misc_feature (5)..(5): Position 5, Xaa is A, D, E, Q, R, S or T
  misc_feature (6)..(6): Position 6, Xaa is H, I, L, P, S, T or W
  misc_feature (7)..(7): Position 7, Xaa is A, E, F, K, N, Q, R, S or Y;
  misc_feature (8)..(8): Position 8, Xaa is D, E, F, Q, R, T or W
  misc_feature (9)..(9): Position 9, Xaa is A, D, P, S, T or W
  misc_feature (10)..(10): Position 10, Xaa is A, D, G, K, N, Q, S or T
  misc_feature (11)..(11): Position 11, Xaa is A, E, L, P, S, T, V or Y
  misc_feature (12)..(12): Position 12, Xaa is V, L, I, E, P, G, Y, M, T or D
  misc_feature (13)..(13): Position 13, Xaa is Y, W or F
  misc_feature (14)..(14): Position 14, Xaa is E, F, V, W or Y
  misc_feature (16)..(16): Position 16, Xaa is P or an azetidine residue;
  misc_feature (18)..(18): Position 18, Xaa is S, A, V or L
  misc_feature (19)..(19): Position 19, Xaa is M, F, V, R, Q, K, T, S, D, L, I or E
  misc_feature (20)..(20): Position 20, Xaa is Q or P.
XXXXXXXXXXXXXXQXYXXXL

SEQ ID NO: 918 - protein, 21 aa, Artificial Sequence
  IL-1 ANTAGONIST PEPTIDE
TANVSSFEWTPGYWQPYALPL

SEQ ID NO: 919 - protein, 18 aa, Artificial Sequence
  IL-1 ANTAGONIST PEPTIDE
SWTDYGYWQPYALPISGL

SEQ ID NO: 920 - protein, 21 aa, Artificial Sequence
  IL-1 ANTAGONIST PEPTIDE
ETPFTWEESNAYYWQPYALPL

SEQ ID NO: 921 - protein, 21 aa, Artificial Sequence
  IL-1 ANTAGONIST PEPTIDE
ENTYSPNWADSMYWQPYALPL

SEQ ID NO: 922 - protein, 21 aa, Artificial Sequence
  IL-1 ANTAGONIST PEPTIDE
SVGEDHNFWTSEYWQPYALPL

SEQ ID NO: 923 - protein, 21 aa, Artificial Sequence
  IL-1 ANTAGONIST PEPTIDE
DGYDRWRQSGERYWQPYALPL

SEQ ID NO: 924 - protein, 15 aa, Artificial Sequence
  IL-1 ANTAGONIST PEPTIDE
FEWTPGYWQPYALPL

SEQ ID NO: 925 - protein, 11 aa, Artificial Sequence
  IL-1 ANTAGONIST PEPTIDE
FEWTPGYWQPY

SEQ ID NO: 926 - protein, 11 aa, Artificial Sequence
  IL-1 ANTAGONIST PEPTIDE
  misc_feature (10)..(10): Position 10, Xaa is an azetidine residue
FEWTPGYWQXY

SEQ ID NO: 927 - protein, 10 aa, Artificial Sequence
  IL-1 ANTAGONIST PEPTIDE
EWTPGYWQPY

SEQ ID NO: 928 - protein, 11 aa, Artificial Sequence
  IL-1 ANTAGONIST PEPTIDE
  misc_feature (10)..(10): Position 10, Xaa is an azetidine residue
FEWTPGWYQXY

SEQ ID NO: 929 - protein, 11 aa, Artificial Sequence
  IL-1 ANTAGONIST PEPTIDE
  misc_feature (10)..(10): Position 10, Xaa is an azetidine residue
AEWTPGYWQXY

SEQ ID NO: 930 - protein, 11 aa, Artificial Sequence
  IL-1 ANTAGONIST PEPTIDE
  misc_feature (10)..(10): Position 10, Xaa is an azetidine residue
FAWTPGYWQXY

SEQ ID NO: 931 - protein, 11 aa, Artificial Sequence
  IL-1 ANTAGONIST PEPTIDE
  misc_feature (10)..(10): Position 10, Xaa is an azetidine residue
FEATPGYWQXY

SEQ ID NO: 932 - protein, 11 aa, Artificial Sequence
  IL-1 ANTAGONIST PEPTIDE
  misc_feature (10)..(10): Position 10, Xaa is an azetidine residue
FEWAPGYWQXY

SEQ ID NO: 933 - protein, 11 aa, Artificial Sequence
  IL-1 ANTAGONIST PEPTIDE
  misc_feature (10)..(10): Position 10, Xaa is an azetidine residue
FEWTAGYWQXY

SEQ ID NO: 934 - protein, 11 aa, Artificial Sequence
  IL-1 ANTAGONIST PEPTIDE
  misc_feature (10)..(10): Position 10, Xaa is an azetidine residue
FEWTPAYWQXY

SEQ ID NO: 935 - protein, 11 aa, Artificial Sequence
  IL-1 ANTAGONIST PEPTIDE
  misc_feature (10)..(10): Position 10, Xaa is an azetidine residue
FEWTPGAWQXY

SEQ ID NO: 936 - protein, 11 aa, Artificial Sequence
  IL-1 ANTAGONIST PEPTIDE
  misc_feature (10)..(10): Position 10, Xaa is an azetidine residue
FEWTPGYAQXY

SEQ ID NO: 937 - protein, 11 aa, Artificial Sequence
  IL-1 ANTAGONIST PEPTIDE
  misc_feature (10)..(10): Position 10, Xaa is an azetidine residue
FEWTPGYWQXA

SEQ ID NO: 938 - protein, 11 aa, Artificial Sequence
  IL-1 ANTAGONIST PEPTIDE
  misc_feature (10)..(10): Position 10, Xaa is an azetidine residue
FEWTGGYWQXY

SEQ ID NO: 939 - protein, 11 aa, Artificial Sequence
  IL-1 ANTAGONIST PEPTIDE
  misc_feature (10)..(10): Position 5, D amino acid residue Position 10, Xaa is an azetidine residue
FEWTPGYWQXY

SEQ ID NO: 940 - protein, 11 aa, Artificial Sequence
  IL-1 ANTAGONIST PEPTIDE
  misc_feature (5)..(10): Position 10, Xaa is an azetidine residue
FEWTXGYWQXY

SEQ ID NO: 941 - protein, 11 aa, Artificial Sequence
  IL-1 ANTAGONIST PEPTIDE
  misc_feature (5)..(5): Position 5, Xaa is a pipecolic acid residue
  misc_feature (10)..(10): Position 10, Xaa is an azetidine residue
FEWTXGYWQXY

SEQ ID NO: 942 - protein, 11 aa, Artificial Sequence
  IL-1 ANTAGONIST PEPTIDE
  misc_feature (6)..(6): Position 6, Xaa is an aminoisobutyric acid residue
  misc_feature (10)..(10): Position 10, Xaa is an azetidine residue
FEWTPXYWQXY

SEQ ID NO: 943 - protein, 11 aa, Artificial Sequence
  IL-1 ANTAGONIST PEPTIDE
  misc_feature (6)..(6): Position 6, Xaa is a sarcosine residue
  misc_feature (10)..(10): Position 10, Xaa is an azetidine residue
FEWTPXWYQXY

SEQ ID NO: 944 - protein, 11 aa, Artificial Sequence
  IL-1 ANTAGONIST PEPTIDE
  misc_feature (5)..(5): Position 5, Xaa is a sarcosine residue
  misc_feature (10)..(10): Position 10, Xaa is an azetidine residue
FEWTXGYWQXY

SEQ ID NO: 945 - protein, 11 aa, Artificial Sequence
  IL-1 ANTAGONIST PEPTIDE
  misc_feature (10)..(10): Position 10, Xaa is an azetidine residue
FEWTPNYWQXY

SEQ ID NO: 946 - protein, 11 aa, Artificial Sequence
  IL-1 ANTAGONIST PEPTIDE
  misc_feature (10)..(10): Position 10, Xaa is an azetidine residue
  misc_feature (5)..(5): Position 5, D amino acid residue
FEWTPVYWQXY

SEQ ID NO: 947 - protein, 11 aa, Artificial Sequence
  IL-1 ANTAGONIST PEPTIDE
  misc_feature (10)..(10): Position 10, Xaa is an azetidine residue
FEWTVPYWQXY

SEQ ID NO: 948 - protein, 11 aa, Artificial Sequence
  IL-1 ANTAGONIST PEPTIDE
  misc_feature (1)..(1): Position 1, acetylated Phe
  misc_feature (10)..(10): Position 10, Xaa is an azetidine residue
FEWTPGWYQXY

SEQ ID NO: 949 - protein, 11 aa, Artificial Sequence
  IL-1 ANTAGONIST PEPTIDE
  misc_feature (1)..(1): Position 1, acetylated Phe
  misc_feature (10)..(10): Position 10, Xaa is an azetidine residue
FEWTPGYWQXY

SEQ ID NO: 950 - protein, 11 aa, Artificial Sequence
  IL-1 ANTAGONIST PEPTIDE
  misc_feature (1)..(1): Position 1, Xaa = 1-naphthylalanine
  misc_feature (10)..(10): Position 10, Xaa is an azetidine residue
XEWTPGYYQXY

SEQ ID NO: 951 - protein, 11 aa, Artificial Sequence
  IL-1 ANTAGONIST PEPTIDE
  misc_feature (10)..(10): Position 10, xaa is an azetidine residue
YEWTPGYYQXY

SEQ ID NO: 952 - protein, 11 aa, Artificial Sequence
  IL-1 ANTAGONIST PEPTIDE
  misc_feature (10)..(10): Position 10, Xaa is an azetidine residue
FEWVPGYYQXY

SEQ ID NO: 953 - protein, 11 aa, Artificial Sequence
  IL-1 ANTAGONIST PEPTIDE
  misc_feature (10)..(10): Position 10, Xaa is an azetidine residue
FEWTPGYYQXY

SEQ ID NO: 954 - protein, 11 aa, Artificial Sequence
  IL-1 ANTAGONIST PEPTIDE
  misc_feature (10)..(10): Position 10, Xaa is an azetidine residue
FEWTPSYYQXY

SEQ ID NO: 955 - protein, 11 aa, Artificial Sequence
  IL-1 ANTAGONIST PEPTIDE
  misc_feature (10)..(10): Position 10, Xaa is an azetidine residue
FEWTPNYYQXY

SEQ ID NO: 956 - protein, 12 aa, Artificial Sequence
  IL-1 ANTAGONIST PEPTIDE
  misc_feature (5)..(5): Position 5, Xaa = naphthylalanine
SHLYXQPYSVQM

SEQ ID NO: 957 - protein, 12 aa, Artificial Sequence
  IL-1 ANTAGONIST PEPTIDE
  misc_feature (5)..(5): Position 5, Xaa = naphthylalanine
TLVYXQPYSLQT

SEQ ID NO: 958 - protein, 12 aa, Artificial Sequence
  IL-1 ANTAGONIST PEPTIDE
  misc_feature (5)..(5): Position 5, Xaa = naphthylalanine
RGDYXQPYSVQS

SEQ ID NO: 959 - protein, 12 aa, Artificial Sequence
  IL-1 ANTAGONIST PEPTIDE
  misc_feature (5)..(5): Position 5, Xaa = naphthylalanine
NMVYXQPYSIQT

SEQ ID NO: 960 - protein, 9 aa, Artificial Sequence
  IL-1 ANTAGONIST PEPTIDE
VYWQPYSVQ

SEQ ID NO: 961 - protein, 9 aa, Artificial Sequence
  IL-1 ANTAGONIST PEPTIDE
  misc_feature (3)..(3): Position 3, Xaa = naphthylalanine
VYXQPYSVQ

SEQ ID NO: 962 - protein, 12 aa, Artificial Sequence
  IL-1 ANTAGONIST PEPTIDE
  misc_feature (7)..(7): Position 7, Xaa is an azetidine residue
TFVYWQXYALPL

SEQ ID NO: 963 - protein, 11 aa, Artificial Sequence
  IL-1 ANTAGONIST PEPTIDE
  misc_feature (10)..(10): Position 10, Xaa is an azetidine residue
  misc_feature (11)..(11): Position 11, Xaa = p-benzoyl-L-phenylalanine
FEWTPGYYQXX

SEQ ID NO: 964 - protein, 11 aa, Artificial Sequence
  IL-1 ANTAGONIST PEPTIDE
  misc_feature (1)..(1): Position 1, Xaa = acetylated Phe
  misc_feature (10)..(10): Position 10, Xaa is an azetidine residue
  misc_feature (11)..(11): Position 11, Xaa = p-benzoyl-L-phenylalanine.
XEWTPGYYQXX

SEQ ID NO: 965 - protein, 11 aa, Artificial Sequence
  IL-1 ANTAGONIST PEPTIDE
  misc_feature (8)..(10): Position 8, Xaa = p-benzoyl-L-phenylalanine Position 10, Xaa is an azetidine residue
  misc_feature (10)..(10): Position 10, Xaa is an azetidine residue
FEWTPGYXQXY

SEQ ID NO: 966 - protein, 11 aa, Artificial Sequence
  IL-1 ANTAGONIST PEPTIDE
  misc_feature (1)..(1): Position 1, Xaa = acetylated Phe
  misc_feature (8)..(8): Position 8, Xaa = p-benzoyl-L-phenylalanine
  misc_feature (10)..(10): Position 10, Xaa is an azetidine residue.
FEWTPGYXQXY

SEQ ID NO: 967 - protein, 11 aa, Artificial Sequence
  IL-1 ANTAGONIST PEPTIDE
  misc_feature (7)..(7): Position 7, Xaa = p-benzoyl-L-phenylalanine
  misc_feature (10)..(10): Position 10, Xaa is an azetidine residue.
FEWTPGXYQXY

SEQ ID NO: 968 - protein, 11 aa, Artificial Sequence
  IL-1 ANTAGONIST PEPTIDE
  misc_feature (1)..(1): Position 1, Xaa = acetylated Phe
  misc_feature (7)..(7): Position 7, Xaa = p-benzoyl-L-phenylalanine
  misc_feature (10)..(10): Position 10, Xaa is an azetidine residue.
FEWTPGXYQXY

SEQ ID NO: 969 - protein, 11 aa, Artificial Sequence
  IL-1 ANTAGONIST PEPTIDE
  misc_feature (1)..(1): Position 1, Xaa = acetylated Phe
  misc_feature (3)..(3): Position 3, Xaa = p-benzoyl-L-phenylalanine
  misc_feature (10)..(10): Position 10, Xaa is an azetidine residue.
FEXTPGYYQXY

SEQ ID NO: 970 - protein, 11 aa, Artificial Sequence
  IL-1 ANTAGONIST PEPTIDE
  misc_feature (1)..(1): Position 1, Xaa = acetylated Phe
  misc_feature (3)..(3): Position 3, Xaa = p-benzoyl-L-phenylalanine
  misc_feature (10)..(10): Position 10, Xaa is an azetidine residue.
FEXTPGYYQXY

SEQ ID NO: 971 - protein, 11 aa, Artificial Sequence
  IL-1 ANTAGONIST PEPTIDE
  misc_feature (1)..(1): Position 1, Xaa = p-benzoyl-L-phenylalanine
  misc_feature (10)..(10): Position 10, Xaa is an azetidine residue.
XEWTPGYYQXY

SEQ ID NO: 972 - protein, 11 aa, Artificial Sequence
  IL-1 ANTAGONIST PEPTIDE
  misc_feature (1)..(1): Position 1, Xaa = acetylated p-benzoyl-L-phenylalanine
  misc_feature (10)..(10): Position 10, Xaa is an azetidine residue.
XEWTPGYYQXY

SEQ ID NO: 973 - protein, 9 aa, Artificial Sequence
  IL-1 ANTAGONIST PEPTIDE
VYWQPYSVQ

SEQ ID NO: 974 - protein, 12 aa, Artificial Sequence
  IL-1 ANTAGONIST PEPTIDE
RLVYWQPYSVQR

SEQ ID NO: 975 - protein, 12 aa, Artificial Sequence
  IL-1 ANTAGONIST PEPTIDE
  misc_feature (5)..(5): Position 5, Xaa = naphthylalanine
RLVYXQPYSVQR

SEQ ID NO: 976 - protein, 12 aa, Artificial Sequence
  IL-1 ANTAGONIST PEPTIDE
RLDYWQPYSVQR

SEQ ID NO: 977 - protein, 12 aa, Artificial Sequence
  IL-1 ANTAGONIST PEPTIDE
RLVWFQPYSVQR

SEQ ID NO: 978 - protein, 12 aa, Artificial Sequence
  IL-1 ANTAGONIST PEPTIDE
RLVYWQPYSIQR

SEQ ID NO: 979 - protein, 11 aa, Artificial Sequence
  IL-1 ANTAGONIST PEPTIDE
  misc_feature (1)..(1): Position 1, Xaa = D or Y
  misc_feature (3)..(3): Position 3, Xaa = D or S
  misc_feature (4)..(4): Position 4, Xaa = S, T or A
  misc_feature (5)..(5): Position 5, Xaa = S or W
  misc_feature (6)..(6): Position 6, Xaa = S or Y
  misc_feature (7)..(7): Xaa is any amino acid
  misc_feature (8)..(8): Position 8, Xaa = N, S, K, H or W
  misc_feature (9)..(9): Position 9, Xaa = F or L
  misc_feature (10)..(10): Position 10, Xaa = D, N, S or L
  misc_feature (11)..(11): Position 11, Xaa = L, I, Q, M or A.
XNXXXXXXXXX

SEQ ID NO: 980 - protein, 11 aa, Artificial Sequence
  IL-1 ANTAGONIST PEPTIDE
DNSSWYDSFLL

SEQ ID NO: 981 - protein, 11 aa, Artificial Sequence
  IL-1 ANTAGONIST PEPTIDE
DNTAWYESFLA

SEQ ID NO: 982 - protein, 11 aa, Artificial Sequence
  IL-1 ANTAGONIST PEPTIDE
DNTAWYENFLL

SEQ ID NO: 983 - protein, 17 aa, Artificial Sequence
  IL-1 ANTAGONIST PEPTIDE
PAREDNTAWYDSFLIWC

SEQ ID NO: 984 - protein, 17 aa, Artificial Sequence
  IL-1 ANTAGONIST PEPTIDE
TSEYDNTTWYEKFLASQ

SEQ ID NO: 985 - protein, 17 aa, Artificial Sequence
  IL-1 ANTAGONIST PEPTIDE
SQIPDNTAWYQSFLLHG

SEQ ID NO: 986 - protein, 17 aa, Artificial Sequence
  IL-1 ANTAGONIST PEPTIDE
SPFIDNTAWYENFLLTY

SEQ ID NO: 987 - protein, 17 aa, Artificial Sequence
  IL-1 ANTAGONIST PEPTIDE
EQIYDNTAWYDHFLLSY

SEQ ID NO: 988 - protein, 17 aa, Artificial Sequence
  IL-1 ANTAGONIST PEPTIDE
TPFIDNTAWYENFLLTY

SEQ ID NO: 989 - protein, 17 aa, Artificial Sequence
  IL-1 ANTAGONIST PEPTIDE
TYTYDNTAWYERFLMSY

SEQ ID NO: 990 - protein, 17 aa, Artificial Sequence
  IL-1 ANTAGONIST PEPTIDE
TMTQDNTAWYENFLLSY

SEQ ID NO: 991 - protein, 17 aa, Artificial Sequence
  IL-1 ANTAGONIST PEPTIDE
TIDNTAWYANLVQTYPQ

SEQ ID NO: 992 - protein, 17 aa, Artificial Sequence
  IL-1 ANTAGONIST PEPTIDE
TIDNTAWYERFLAQYPD

SEQ ID NO: 993 - protein, 17 aa, Artificial Sequence
  IL-1 ANTAGONIST PEPTIDE
HIDNTAWYENFLLTYTP

SEQ ID NO: 994 - protein, 17 aa, Artificial Sequence
  IL-1 ANTAGONIST PEPTIDE
SQDNTAWYENFLLSYKA

SEQ ID NO: 995 - protein, 17 aa, Artificial Sequence
  IL-1 ANTAGONIST PEPTIDE
QIDNTAWYERFLLQYNA

SEQ ID NO: 996 - protein, 17 aa, Artificial Sequence
  IL-1 ANTAGONIST PEPTIDE
NQDNTAWYESFLLQYNT

SEQ ID NO: 997 - protein, 17 aa, Artificial Sequence
  IL-1 ANTAGONIST PEPTIDE
TIDNTAWYENFLLNHNL

SEQ ID NO: 998 - protein, 17 aa, Artificial Sequence
  IL-1 ANTAGONIST PEPTIDE
HYDNTAWYERFLQQGWH

SEQ ID NO: 999 - protein, 21 aa, Artificial Sequence
  IL-1 ANTAGONIST PEPTIDE
ETPFTWEESNAYYWQPYALPL

SEQ ID NO: 1000 - protein, 21 aa, Artificial Sequence
  IL-1 ANTAGONIST PEPTIDE
YIPFTWEESNAYYWQPYALPL

SEQ ID NO: 1001 - protein, 21 aa, Artificial Sequence
  IL-1 ANTAGONIST PEPTIDE
DGYDRWRQSGERYWQPYALPL

SEQ ID NO: 1002 - protein, 11 aa, Artificial Sequence
  IL-1 ANTAGONIST PEPTIDE
  misc_feature (1)..(1): Position 1, Xaa = phosphotyrosine
  misc_feature (2)..(2): Position 2, Xaa = naphthylalanine
  misc_feature (3)..(3): Position 3, Xaa = phosphotyrosine
  misc_feature (6)..(6): Position 6, Xaa is an azetidine residue.
XXXQQXYALPL

SEQ ID NO: 1003 - protein, 21 aa, Artificial Sequence
  IL-1 ANTAGONIST PEPTIDE
TANVSSFEWTPGYWQPYALPL

SEQ ID NO: 1004 - protein, 15 aa, Artificial Sequence
  IL-1 ANTAGONIST PEPTIDE
  misc_feature (10)..(10): Position 10, Xaa = azetidine
FEWTPGYWQXYALPL

SEQ ID NO: 1005 - protein, 17 aa, Artificial Sequence
  IL-1 ANTAGONIST PEPTIDE
FEWTPGYWQPYALPLSD

SEQ ID NO: 1006 - protein, 15 aa, Artificial Sequence
  IL-1 ANTAGONIST PEPTIDE
  misc_feature (10)..(10): Position 10, Xaa = azetidine
FEWTPGYYQXYALPL

SEQ ID NO: 1007 - protein, 11 aa, Artificial Sequence
  IL-1 ANTAGONIST PEPTIDE
  misc_feature (10)..(10): Position 10, Xaa = azetidine
FEWTPGYWQXY

SEQ ID NO: 1008 - protein, 11 aa, Artificial Sequence
  IL-1 ANTAGONIST PEPTIDE
  misc_feature (1)..(1): Position 1 is acetylated Phe
  misc_feature (10)..(10): Position 10, Xaa = azetidine
FEWTPGYWQXY

SEQ ID NO: 1009 - protein, 11 aa, Artificial Sequence
  IL-1 ANTAGONIST PEPTIDE
  misc_feature (10)..(10): Position 1 is acetylated Phe Position 10, Xaa = azetidine
FEWTPGWYQXY

SEQ ID NO: 1010 - protein, 11 aa, Artificial Sequence
  IL-1 ANTAGONIST PEPTIDE
  misc_feature (1)..(1): Position 1 is acetylated Phe
  misc_feature (10)..(10): Position 10, Xaa = azetidine
FEWTPGYYQXY

SEQ ID NO: 1011 - protein, 11 aa, Artificial Sequence
  IL-1 ANTAGONIST PEPTIDE
  misc_feature (1)..(1): Position 1 is acetylated Phe
  misc_feature (10)..(10): Position 10, Xaa = azetidine
FEWTPAYWQXY

SEQ ID NO: 1012 - protein, 11 aa, Artificial Sequence
  IL-1 ANTAGONIST PEPTIDE
  misc_feature (1)..(1): Position 1 is acetylated Phe
  misc_feature (10)..(10): Position 10, Xaa = azetidine
FEWTPAWYQXY

SEQ ID NO: 1013 - protein, 11 aa, Artificial Sequence
  IL-1 ANTAGONIST PEPTIDE
  misc_feature (1)..(1): Position 1 is acetylated Phe
  misc_feature (10)..(10): Position 10, Xaa = azetidine
FEWTPAYYQXY

SEQ ID NO: 1014 - protein, 15 aa, Artificial Sequence
  IL-1 ANTAGONIST PEPTIDE
  misc_feature (10)..(10): Position 10, Xaa = azetidine
FEWTPGYYQXYALPL

SEQ ID NO: 1015 - protein, 15 aa, Artificial Sequence
  IL-1 ANTAGONIST PEPTIDE
  misc_feature (10)..(10): Position 10, Xaa = azetidine
FEWTPGYWQXYALPL

SEQ ID NO: 1016 - protein, 15 aa, Artificial Sequence
  IL-1 ANTAGONIST PEPTIDE
  misc_feature (10)..(10): Position 10, Xaa = azetidine
FEWTPGWYQXYALPL

SEQ ID NO: 1017 - protein, 21 aa, Artificial Sequence
  IL-1 ANTAGONIST PEPTIDE
TANVSSFEWTPGYWQPYALPL

SEQ ID NO: 1018 - protein, 11 aa, Artificial Sequence
  IL-1 ANTAGONIST PEPTIDE
  misc_feature (10)..(10): Position 10, Xaa = azetidine
  misc_feature (1)..(1): Position 1 is acetylated Phe
FEWTPGYWQXY

SEQ ID NO: 1019 - protein, 11 aa, Artificial Sequence
  IL-1 ANTAGONIST PEPTIDE
  misc_feature (1)..(1): Position 1 is acetylated Phe
  misc_feature (10)..(10): Position 10, Xaa = azetidine
FEWTPGWYQXY

SEQ ID NO: 1020 - protein, 11 aa, Artificial Sequence
  IL-1 ANTAGONIST PEPTIDE
  misc_feature (1)..(1): Position 1 is acetylated Phe
  misc_feature (10)..(10): Position 10, Xaa = azetidine
FEWTPGYYQXY

SEQ ID NO: 1021 - protein, 11 aa, Artificial Sequence
  IL-1 ANTAGONIST PEPTIDE
  misc_feature (1)..(1): Position 1 is acetylated Phe
  misc_feature (6)..(6): Position 6, D amino acid residue
  misc_feature (10)..(10): Position 10, Xaa = azetidine.
FEWTPAYWQXY

SEQ ID NO: 1022 - protein, 11 aa, Artificial Sequence
  IL-1 ANTAGONIST PEPTIDE
  misc_feature (1)..(1): Position 1 is acetylated Phe
  misc_feature (6)..(6): Position 6, D amino acid residue
  misc_feature (10)..(10): Position 10, Xaa = azetidine.
FEWTPAWYQXY

SEQ ID NO: 1023 - protein, 11 aa, Artificial Sequence
  IL-1 ANTAGONIST PEPTIDE
  misc_feature (1)..(1): Position 1 is acetylated Phe
  misc_feature (6)..(6): Position 6, D amino acid residue
  misc_feature (10)..(10): Position 10, Xaa = azetidine.
FEWTPAYYQXY

SEQ ID NO: 1024 - protein, 20 aa, Artificial Sequence
  EPO-MIMETIC PEPTIDE
GGLYLCRFGPVTWDCGYKGG

SEQ ID NO: 1025 - protein, 20 aa, Artificial Sequence
  EPO-MIMETIC PEPTIDE
GGTYSCHFGPLTWVCKPQGG

SEQ ID NO: 1026 - protein, 20 aa, Artificial Sequence
  EPO-MIMETIC PEPTIDE
GGDYHCRMGPLTWVCKPLGG

SEQ ID NO: 1027 - protein, 19 aa, Artificial Sequence
  VEGF-ANTAGONIST
VEPNCDIHVMWEWECFERL

SEQ ID NO: 1028 - protein, 10 aa, Artificial Sequence
  MMP INHIBITOR
CTTHWGFTLC

SEQ ID NO: 1029 - protein, 20 aa, Artificial Sequence
  EPO-MIMETIC PEPTIDE
VGNYMCHFGPITWVCRPGGG

SEQ ID NO: 1030 - protein, 20 aa, Artificial Sequence
  EPO-MIMETIC PEPTIDE
GGVYACRMGPITWVCSPLGG

SEQ ID NO: 1031 - protein, 20 aa, Artificial Sequence
  VEGF- ANTAGONIST
RGWVEICAADDYGRCLTEAQ

SEQ ID NO: 1032 - protein, 19 aa, Artificial Sequence
  TPO-MIMETIC
  misc_feature (1)..(1): Fc domain attached at Position 1 of the N-terminus
GGGGGIEGPTLRQWLAARA

SEQ ID NO: 1033 - protein, 19 aa, Artificial Sequence
  TPO-MIMETIC
  misc_feature (19)..(19): Fc domain attached at Position 19 of the C-terminus
IEGPTLRQWLAARAGGGGG

SEQ ID NO: 1034 - protein, 25 aa, Artificial Sequence
  EPO-MIMETIC
  misc_feature (25)..(25): Fc domain attached at Position 25 of the C-terminus
GGTYSCHFGPLTWVCKPQGGGGGGG

SEQ ID NO: 1035 - protein, 19 aa, Artificial Sequence
  EPO-MIMETIC PEPTIDE
VGNYMAHMGPITWVCRPGG

SEQ ID NO: 1036 - protein, 18 aa, Artificial Sequence
  EPO-MIMETIC PEPTIDE
GGTYSCHFGPLTWVCKPQ

SEQ ID NO: 1037 - protein, 20 aa, Artificial Sequence
  EPO-MIMETIC PEPTIDE
GGLYACHMGPMTWVCQPLRG

SEQ ID NO: 1038 - protein, 22 aa, Artificial Sequence
  EPO-MIMETIC PEPTIDE
TIAQYICYMGPETWECRPSPKA

SEQ ID NO: 1039 - protein, 13 aa, Artificial Sequence
  EPO-MIMETIC PEPTIDE
YSCHFGPLTWVCK

SEQ ID NO: 1040 - protein, 11 aa, Artificial Sequence
  EPO-MIMETIC PEPTIDE
YCHFGPLTWVC

SEQ ID NO: 1041 - protein, 12 aa, Artificial Sequence
  EPO-MIMETIC PEPTIDE
SCHFGPLTWVCK

SEQ ID NO: 1042 - protein, 11 aa, Artificial Sequence
  EPO-MIMETIC PEPTIDE
  misc_feature (1)..(1): Xaa (Pos1) can be any one of the 20 L-amino acids; except Xaa (Po s1) may/may not be Y and Xaa (Pos1) may be any non-naturally occu rring aromatic acid analog when Xaa (Pos1) is Y.
  misc_feature (2)..(8): Xaa (Pos2, 8) can be any one of the 20 L-amino acids
  misc_feature (3)..(3): Xaa (Pos3) can be C, A, a-amino-y-bromobutyric acid or Hoc;
  misc_feature (4)..(4): Xaa (Pos4) can be R, H, L or W
  misc_feature (5)..(5): Xaa (Pos5) can be M, F or I
  misc_feature (10)..(10): Xaa is any amino acid
  misc_feature (11)..(11): Xaa (Pos11) can be D, E, I, L or V
  misc_feature (12)..(12): Xaa (Pos12) can be C, A, a-amino-y-bromobutyric acid or Hoc provi ded that either Xaa (Pos3, 12) is C or Hoc.
XXXXGPXTWXX

SEQ ID NO: 1043 - protein, 5 aa, Artificial Sequence
  INTEGRIN-BINDING PEPTIDE
  misc_feature (3)..(4): Xaa = any amino acid
DLXXL

SEQ ID NO: 1044 - protein, 12 aa, Artificial Sequence
  INTEGRIN-BINDING PEPTIDE
RTDLDSLRTYTL

SEQ ID NO: 1045 - protein, 20 aa, Artificial Sequence
  TNF-ALPHA INHIBITOR
  misc_feature (1)..(1): Fc domain attached at Position 1 of the N-terminus
GGGGGDFLPHYKNTSLGHRP

SEQ ID NO: 1046 - protein, 20 aa, Artificial Sequence
  TNF-ALPHA INHIBITOR
  misc_feature (20)..(20): Fc domain attached at Position 20 of the C-terminus
DFLPHYKNTSLGHRPGGGGG

SEQ ID NO: 1047 - protein, 20 aa, Artificial Sequence
  IL-1 ANTAGONIST
  misc_feature (1)..(1): Fc domain attached at Position 1 of the N-terminus
GGGGGFEWTPGYWQPYALPL

SEQ ID NO: 1048 - protein, 20 aa, Artificial Sequence
  IL-1 ANTAGONIST
  misc_feature (20)..(20): Fc domain attached at Position 20 of the C-terminus
FEWTPGYWQPYALPLGGGGG

SEQ ID NO: 1049 - protein, 24 aa, Artificial Sequence
  VEGF-ANTAGONIST
  misc_feature (1)..(1): Fc domain attached at Position 1 of the N-terminus
GGGGGVEPNCDIHVMWEWECFERL

SEQ ID NO: 1050 - protein, 24 aa, Artificial Sequence
  VEGF-ANTAGONIST
  misc_feature (24)..(24): Fc domain attached at Position 24 of the C-terminus
VEPNCDIHVMWEWECFERLGGGGG

SEQ ID NO: 1051 - protein, 15 aa, Artificial Sequence
  MMP INHIBITOR
  misc_feature (1)..(1): Fc domain attached at Position 1 of the N-terminus
GGGGGCTTHWGFTLC

SEQ ID NO: 1052 - protein, 15 aa, Artificial Sequence
  MMP INHIBITOR
  misc_feature (15)..(15): Fc domain attached at Position 15 of the C-terminus
CTTHWGFTLCGGGGG

SEQ ID NO: 1053 - protein, 10 aa, Artificial Sequence
  INTEGRIN-BINDING PEPTIDE
RTDLDSLRTY

SEQ ID NO: 1054 - protein, 9 aa, Artificial Sequence
  INTEGRIN-BINDING PEPTIDE
RTDLDSLRT

SEQ ID NO: 1055 - DNA, 757 bp, Artificial Sequence
  FC-TNF-ALPA INHIBITORS
  CDS (4)..(747)
catatggacaaaactcacacatgtccaccttgtccagctccggaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggaggtggtggtgacttcctgccgcactacaaaaacacctctctgggtcaccgtccgtaatggatcc

SEQ ID NO: 1056 - protein, 248 aa, Artificial Sequence
  FC-TNF-ALPA INHIBITORS
MDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGGDFLPHYKNTSLGHRP

SEQ ID NO: 1057 - DNA, 761 bp, Artificial Sequence
  TNF-ALPHA INHIBITOR-Fc
  CDS (4)..(747)
catatggacttcctgccgcactacaaaaacacctctctgggtcaccgtccgggtggaggcggtggggacaaaactcacacatgtccaccttgcccagcacctgaactcctggggggaccgtcagttttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaataatggatccgcgg

SEQ ID NO: 1058 - protein, 248 aa, Artificial Sequence
  TNF-ALPHA INHIBITOR-Fc
MDFLPHYKNTSLGHRPGGGGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1059 - DNA, 763 bp, Artificial Sequence
  FC-IL-1 ANTAGONIST
  CDS (4)..(747)
catatggacaaaactcacacatgtccaccttgtccagctccggaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggaggtggtggtttcgaatggaccccgggttactggcagccgtacgctctgccgctgtaatggatccctcgag

SEQ ID NO: 1060 - protein, 248 aa, Artificial Sequence
  FC-IL-1 ANTAGONIST
MDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGGFEWTPGYWQPYALPL

SEQ ID NO: 1061 - DNA, 757 bp, Artificial Sequence
  IL-1 ANTAGONIST-FC
  CDS (4)..(747)
catatgttcgaatggaccccgggttactggcagccgtacgctctgccgctgggtggaggcggtggggacaaaactcacacatgtccaccttgcccagcacctgaactcctggggggaccgtcagttttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaataatggatcc

SEQ ID NO: 1062 - protein, 248 aa, Artificial Sequence
  IL-1 ANTAGONIST-FC
MFEWTPGYWQPYALPLGGGGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1063 - DNA, 773 bp, Artificial Sequence
  Fc-VEGF ANTAGONIST
  CDS (4)..(759)
catatggacaaaactcacacatgtccaccgtgcccagcacctgaactcctggggggaccgtcagttttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggtggtggtggtgttgaaccgaactgtgacatccatgttatgtgggaatgggaatgttttgaacgtctgtaactcgaggatcc

SEQ ID NO: 1064 - protein, 252 aa, Artificial Sequence
  Fc-VEGF ANTAGONIST
MDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGGVEPNCDIHVMWEWECFERL

SEQ ID NO: 1065 - DNA, 773 bp, Artificial Sequence
  VEGF ANTAGONIST-Fc
  CDS (4)..(759)
catatggttgaaccgaactgtgacatccatgttatgtgggaatgggaatgttttgaacgtctgggtggtggtggtggtgacaaaactcacacatgtccaccgtgcccagcacctgaactcctggggggaccgtcagttttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaataactcgaggatcc

SEQ ID NO: 1066 - protein, 252 aa, Artificial Sequence
  VEGF ANTAGONIST-Fc
MVEPNCDIHVMWEWECFERLGGGGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1067 - DNA, 748 bp, Artificial Sequence
  Fc MMP INHIBITOR
  CDS (4)..(732)
catatggacaaaactcacacatgtccaccttgtccagctccggaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggaggtggtggttgcaccacccactggggtttcaccctgtgctaatggatccctcgag

SEQ ID NO: 1068 - protein, 243 aa, Artificial Sequence
  Fc MMP INHIBITOR
MDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGGCTTHWGFTLC

SEQ ID NO: 1069 - DNA, 763 bp, Artificial Sequence
  MMP INHIBITOR-Fc
  CDS (4)..(753)
catatgtgcaccacccactggggtttcaccctgtgcggtggaggcggtggggacaaaggtggaggcggtggggacaaaactcacacatgtccaccttgcccagcacctgaactcctggggggaccgtcagttttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaataatggatcc

SEQ ID NO: 1070 - protein, 250 aa, Artificial Sequence
  MMP INHIBITOR-Fc
MCTTHWGFTLCGGGGGDKGGGGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1071 - protein, 13 aa, Artificial Sequence
  INTEGRIN-BINDING PEPTIDE
CGRECPRLCQSSC

SEQ ID NO: 1072 - protein, 13 aa, Artificial Sequence
  INTEGRIN-BINDING PEPTIDE
CNGRCVSGCAGRC

SEQ ID NO: 1073 - protein, 8 aa, Artificial Sequence
  INTEGRIN-BINDING PEPTIDE
CLSGSLSC

SEQ ID NO: 1074 - protein, 6 aa, Artificial Sequence
  INTEGRIN-BINDING PEPTIDE
NGRAHA

SEQ ID NO: 1075 - protein, 5 aa, Artificial Sequence
  INTEGRIN-BINDING PEPTIDE
CNGRC

SEQ ID NO: 1076 - protein, 9 aa, Artificial Sequence
  INTEGRIN-BINDING PEPTIDE
CDCRGDCFC

SEQ ID NO: 1077 - protein, 7 aa, Artificial Sequence
  INTEGRIN-BINDING PEPTIDE
CGSLVRC

SEQ ID NO: 1078 - protein, 8 aa, Artificial Sequence
  INTEGRIN-BINDING PEPTIDE
RTDLDSLR

SEQ ID NO: 1079 - protein, 12 aa, Artificial Sequence
  INTEGRIN-BINDING PEPTIDE
GDLDLLKLRLTL

SEQ ID NO: 1080 - protein, 12 aa, Artificial Sequence
  INTEGRIN-BINDING PEPTIDE
GDLHSLRQLLSR

SEQ ID NO: 1081 - protein, 12 aa, Artificial Sequence
  INTEGRIN-BINDING PEPTIDE
RDDLHMLRLQLW

SEQ ID NO: 1082 - protein, 12 aa, Artificial Sequence
  INTEGRIN-BINDING PEPTIDE
SSDLHALKKRYG

SEQ ID NO: 1083 - protein, 12 aa, Artificial Sequence
  INTEGRIN-BINDING PEPTIDE
RGDLKQLSELTW

SEQ ID NO: 1084 - protein, 12 aa, Artificial Sequence
  INTEGRIN-BINDING PEPTIDE
RGDLAALSAPPV

SEQ ID NO: 1085 - protein, 20 aa, Artificial Sequence
  VEGF-ANTAGONIST
RGWVEICVADDNGMCVTEAQ

SEQ ID NO: 1086 - protein, 19 aa, Artificial Sequence
  VEGF-ANTAGONIST
GWDECDVARMWEWECFAGV

SEQ ID NO: 1087 - protein, 16 aa, Artificial Sequence
  VEGF-ANTAGONIST
RGWVEICESDVWGRCL

SEQ ID NO: 1088 - protein, 16 aa, Artificial Sequence
  VEGF-ANTAGONIST
RGWVEICESDVWGRCL

SEQ ID NO: 1089 - protein, 19 aa, Artificial Sequence
  VEGF-ANTAGONIST
GGNECDIARMWEWECFERL

SEQ ID NO: 1090 - protein, 16 aa, Artificial Sequence
  VEGF-ANTAGONIST
RGWVEICAADDYGRCL

SEQ ID NO: 1091 - protein, 8 aa, Artificial Sequence
  MMP INHIBITOR
  misc_feature (6)..(6): Xaa = any amino acid
CLRSGXGC

SEQ ID NO: 1092 - protein, 10 aa, Artificial Sequence
  MMP INHIBITOR
  misc_feature (2, 3, 8)..(9): Xaa = any amino acid.
CXXHWGFXXC

SEQ ID NO: 1093 - protein, 5 aa, Artificial Sequence
  MMP INHIBITOR
  misc_feature (2)..(4): Xaa = any amino acid
CXPXC

SEQ ID NO: 1094 - protein, 10 aa, Artificial Sequence
  MMP INHIBITOR
CRRHWGFEFC

SEQ ID NO: 1095 - protein, 10 aa, Artificial Sequence
  MMP INHIBITOR
STTHWGFTLS

SEQ ID NO: 1096 - protein, 10 aa, Artificial Sequence
  CTLA4-MIMETIC
CSLHWGFWWC

SEQ ID NO: 1097 - protein, 15 aa, Artificial Sequence
  CARBOHYDRATE (GD1 ALPHA) MIMETIC
WHWRHRIPLQLAAGR

SEQ ID NO: 1098 - protein, 6 aa, Artificial Sequence
  BETA2GPI AB BINDING
LKTPRV

SEQ ID NO: 1099 - protein, 8 aa, Artificial Sequence
  BETA2GPI AB BINDING
NTLKTPRV

SEQ ID NO: 1100 - protein, 11 aa, Artificial Sequence
  BETA2GPI AB BINDING
NTLKTPRVGGC

SEQ ID NO: 1101 - protein, 6 aa, Artificial Sequence
  BETA2GPI AB BINDING
KDKATF

SEQ ID NO: 1102 - protein, 10 aa, Artificial Sequence
  BETA2GPI AB BINDING
KDKATFGCHD

SEQ ID NO: 1103 - protein, 12 aa, Artificial Sequence
  BETA2GPI AB BINDING
KDKATFGCHDGC

SEQ ID NO: 1104 - protein, 6 aa, Artificial Sequence
  BETA2GPI AB BINDING
TLRVYK

SEQ ID NO: 1105 - protein, 9 aa, Artificial Sequence
  BETA2GPI AB BINDING
ATLRVYKGG

SEQ ID NO: 1106 - protein, 10 aa, Artificial Sequence
  BETA2GPI AB BINDING
CATLRVYKGG

SEQ ID NO: 1107 - protein, 14 aa, Artificial Sequence
  MEMBRANE-TRANSPORTING
INLKALAALAKKIL

SEQ ID NO: 1108 - protein, 12 aa, Artificial Sequence
  MEMBRANE-TRANSPORTING
GWTLNSAGYLLG

SEQ ID NO: 1109 - protein, 27 aa, Artificial Sequence
  MEMBRANE-TRANSPORTING
GWTLNSAGYLLGKINLKALAALAKKIL

SEQ ID NO: 1110 - DNA, 57 bp, Artificial Sequence
  Fc VEGF ANTAGONIST
gttgaaccgaactgtgacatccatgttatgtgggaatgggaatgttttgaacgtctg

SEQ ID NO: 1111 - DNA, 57 bp, Artificial Sequence
  Fc VEGF ANTAGONIST
cagacgttcaaaacattcccattcccacataacatggatgtcacagttcggttcaac

SEQ ID NO: 1112 - DNA, 81 bp, Artificial Sequence
  Fc-TNA-ALPHA INHIBITORS
ccgcggatccattacggacggtgacccagagaggtgtttttgtagtgcggcaggaagtcaccaccacctccacctttaccc

SEQ ID NO: 1113 - DNA, 57 bp, Artificial Sequence; identical to SEQ ID NO: 1110
  Fc VEGF ANTAGONIST
  CDS (1)..(57)

SEQ ID NO: 1114 - protein, 19 aa, Artificial Sequence
  Fc VEGF ANTAGONIST
VEPNCDIHVMWEWECFERL

SEQ ID NO: 1115 - DNA, 66 bp, Artificial Sequence
  Fc MMP INHIBITOR
ccgcggatccattagcacagggtgaaaccccagtgggtggtgcaaccaccacctccacctttaccc

SEQ ID NO: 1116 - DNA, 63 bp, Artificial Sequence
  MMP INHIBITOR Fc
gaataacatatgtgcaccacccactggggtttcaccctgtgcggtggaggcggtggggacaaa

SEQ ID NO: 1117 - DNA, 81 bp, Artificial Sequence
  TNF-ALPHA INHIBITOR Fc
gaataacatatggacttcctgccgcactacaaaaacacctctctgggtcaccgtccgggtggaggcggtggggacaaaact

SEQ ID NO: 1118 - DNA, 81 bp, Artificial Sequence
  Fc IL-1 ANTAGONIST
ccgcggatccattacagcggcagagcgtacggctgccagtaacccggggtccattcgaaaccaccacctccacctttaccc

SEQ ID NO: 1119 - DNA, 81 bp, Artificial Sequence
  IL-1 ANTAGONIST Fc
gaataacatatgttcgaatggaccccgggttactggcagccgtacgctctgccgctgggtggaggcggtggggacaaaact

SEQ ID NO: 1120 - DNA, 48 bp, Artificial Sequence
  Fc VEGF ANTAGONIST
atttgattctagaaggaggaataacatatggacaaaactcacacatgt

SEQ ID NO: 1121 - DNA, 51 bp, Artificial Sequence
  Fc VEGF ANTAGONIST
gtcacagttcggttcaacaccaccaccaccacctttacccggagacaggga

SEQ ID NO: 1122 - DNA, 54 bp, Artificial Sequence
  Fc VEGF ANTAGONIST
tccctgtctccgggtaaaggtggtggtggtggtgttgaaccgaactgtgacatc

SEQ ID NO: 1123 - DNA, 39 bp, Artificial Sequence
  Fc VEGF ANTAGONIST
ccgcggatcctcgagttacagacgttcaaaacattccca

SEQ ID NO: 1124 - DNA, 48 bp, Artificial Sequence
  VEGF ANTAGONIST Fc
atttgattctagaaggaggaataacatatggttgaaccgaactgtgac

SEQ ID NO: 1125 - DNA, 51 bp, Artificial Sequence
  VEGF ANTAGONIST Fc
  misc_feature (2)..(2): Position 2, Xaa is L-lys, D-lys, or an ornithyl residue
  misc_feature (3)..(3): Position 3, Xaa is L-tyr, D-ytr, phe, trp, or a p-aminophenylalan yl residue
  misc_feature (4)..(4): Position 4, Xaa is a hydropholic aliphatic amino acid residue
  misc_feature (4)..(4): Position 4, optional attachment to leu, norleucyl, D-ala, Asn-Ser , asn-ser-ile, asn-ser-tyr, asn-ser-ile-leu, asn-ser-tyr-leu, or asn-ser-tyr-leu-asn
acatgtgtgagttttgtcaccaccaccaccacccagacgttcaaaacattc

SEQ ID NO: 1126 - DNA, 51 bp, Artificial Sequence
  VEGF ANTAGONIST Fc
gaatgttttgaacgtctgggtggtggtggtggtgacaaaactcacacatgt

SEQ ID NO: 1127 - DNA, 39 bp, Artificial Sequence
  VEGF ANTAGONIST Fc
ccgcggatcctcgagttatttacccggagacagggagag

SEQ ID NO: 1128 - protein, 36 aa, Artificial Sequence; identical to SEQ ID NO: 3
  SYNTHETIC SCHEME FOR PREPARATION OF PEGYLATED PEPTIDE
  misc_feature (1)..(1): Butoxycarbonyl group attached to the amino terminus.
  misc_feature (2, 5, 24 and)..(27): Tert-butyl group attached to the sidechain.
  misc_feature (7, 13, 29 and)..(35): 2,2,4,6,7-pendamethyldihydrobenzofuran-5-sulfonyl group attached to the sidechain.
  misc_feature (8 and)..(30): Trityl group attached to the sidechain.
  misc_feature (9 and)..(31): Butoxycarbonyl group attached to the sidechain.
  misc_feature (18)..(18): 1-(4,4-dimethyl-2,6-dioxo-cyclohexylidene)ethyl group attached to the sidechain.
  misc_feature (36)..(36): Methoxy resin attached to the carboxyl terminus.

SEQ ID NO: 1129 - protein, 36 aa, Artificial Sequence; identical to SEQ ID NO: 3
  SYNTHETIC SCHEME FOR PREPARATION OF PEGYLATED PEPTIDE
  misc_feature (1)..(1): Butoxycarbonyl group attached to the amino terminus.
  misc_feature (2, 5, 24 and)..(27): Tert-butyl group attached to the sidechain.
  misc_feature (7, 12, 29 and)..(35): 2,2,4,6,7-pendamethyldihydrobenzofuran-5-sulfonyl group attached to the sidechain.
  misc_feature (8 and)..(30): Trityl group attached to the sidechain.
  misc_feature (9 and)..(31): Butoxycarbonyl group attached to the sidechain.
  misc_feature (36)..(36): Methoxy resin attached to the carboxyl terminus.

SEQ ID NO: 1130 - protein, 36 aa, Artificial Sequence; identical to SEQ ID NO: 3
  SYNTHETIC SCHEME FOR PREPARATION OF PEGYLATED PEPTIDE
  misc_feature (1)..(1): Butoxycarbonyl group attached to the amino terminus.
  misc_feature (2, 5, 24 and)..(27): Tert-butyl group attached to the sidechain.
  misc_feature (7, 13, 29 and)..(35): 2,2,4,6,7-pendamethyldihydrobenzofuran-5-sulfonyl group attached to the sidechain.
  misc_feature (8 and)..(30): Trityl group attached to the sidechain.
  misc_feature (9 and)..(31): Butoxycarbonyl group attached to the sidechain.
  misc_feature (18)..(18): Bromoacetyl group attached to the sidechain.
  misc_feature (36)..(36): Methoxy resin attached to the carboxyl terminus.

SEQ ID NO: 1131 - protein, 36 aa, Artificial Sequence; identical to SEQ ID NO: 3
  SYNTHETIC SCHEME FOR PREPARATION OF PEGYLATED PEPTIDE
  misc_feature (18)..(18): Bromoacetyl group attached to the sidechain.

SEQ ID NO: 1132 - protein, 36 aa, Artificial Sequence; identical to SEQ ID NO: 4
  SYNTHETIC SCHEME FOR PREPARATION OF PEGYLATED PEPTIDE
  misc_feature (2, 5, 24 and)..(27): Tert-butyl group attached to the sidechain.
  misc_feature (7, 13, 29 and)..(35): 2,2,4,6,7-pendamethyldihydrobenzofuran-5-sulfonyl group attached to the sidechain.
  misc_feature (8, 18 and)..(30): Trityl group attached to the sidechain.
  misc_feature (9 and)..(31): Butoxycarbonyl group attached to the sidechain.
  misc_feature (36)..(36): Methoxy resin attached to the carboxyl terminus.

SEQ ID NO: 1133 - protein, 36 aa, Artificial Sequence; identical to SEQ ID NO: 4
  SYNTHETIC SCHEME FOR PREPARATION OF PEGYLATED PEPTIDE

What is claimed is:

1. A composition of matter of the formula $$(X^1)_a\text{-}F^1\text{-}(X^2)_b$$

and multimers thereof, wherein:

$F^1$ is an Fc domain;

$X^1$ and $X^2$ are each independently selected from $\text{-}(L^1)_c\text{-}P^1$, $\text{-}(L^1)_c\text{-}P^1\text{-}(L^2)_d\text{-}P^2$, $\text{-}(L^1)_c\text{-}P^1\text{-}(L^2)_d\text{-}P^2\text{-}(L^3)_e\text{-}P^3$, and $\text{-}(L^1)_c\text{-}P^1\text{-}(L^2)_d\text{-}P^2\text{-}(L^3)_e\text{-}P^3\text{-}(L^4)_f\text{-}P^4$ $P^1$, $P^2$, $P^3$, and $P^4$ are each independently randomized IL-1 antagonist peptide sequences;

$L^1$, $L^2$, $L^3$, and $L^4$ are each independently linkers; and a, b, c, d, e, and f are each independently 0 or 1, provided that at least one of a and b is 1 and wherein "peptide" refers to molecules of 2 to 40 amino acids and wherein neither $X^1$ nor $X^2$ is a native protein.

2. The composition of matter of claim 1 of the formulae $$X^1\text{-}F^1$$

or $$F^1\text{-}X^2.$$

3. The composition of matter of claim 1 of the formula $$F^1\text{-}(L^1)_c\text{-}P^1.$$

4. The composition of matter of claim 1 of the formula $$F^1\text{-}(L^1)_c\text{-}P^1\text{-}(L^2)_d\text{-}P^2.$$

5. The composition of matter of claim 1 wherein $F^1$ is an IgG Fc domain.

6. The composition of matter of claim 1 wherein $F^1$ is an IgG1 Fc domain.

7. The composition of matter of claim 1 wherein $F^1$ comprises the sequence of SEQ ID NO: 2.

8. The composition of matter of claim 1 wherein the IL-1 antagonist peptide sequences are selected from SEQ ID NOS: 213 to 271, 671 to 906, 911 to 916, and 918 to 1023.

9. The composition of matter of claim 1, wherein the IL-1 antagonist peptide sequences are selected from Table 4.

10. The composition of matter of claim 1, wherein c is 1.

* * * * *

UNITED STATES PATENT AND TRADEMARK OFFICE
CERTIFICATE OF CORRECTION

PATENT NO. : 6,660,843 B1
DATED : December 9, 2003
INVENTOR(S) : Ulrich Feige and Chuan-Fa Liu It is certified that error appears in the above-identified patent and that said Letters Patent is hereby corrected as shown below:

Column 51,
Line 12, change "cc-lactose" to -- α-lactose --.

Column 52,
Line 50, change "(interferon-65" to -- ( interferon-γ --.

Column 56,
Line 65, change "464-15 71)." to -- 464-71). --.

Column 57,
Line 39, change "thiol-20" to -- thiol- --.

Column 63,
Line 33, delete "45" between "as" and "the".

Column 69,
Line 16, change "eb" to -- ebg --.

Column 70,
Line 13, change ".-mercaptoethanol" to -- β-mercaptoethanol --.
Line 54, delete "15" between "inclusion" and "bodies".

Column 71,
Line 17, change "A1" to -- μl --.

Column 77,
Line 5, delete "20" between "reaction" and "with"

Signed and Sealed this

Ninth Day of March, 2004

JON W. DUDAS
*Acting Director of the United States Patent and Trademark Office*